United States Patent
Zheng et al.

(10) Patent No.: US 11,332,744 B1
(45) Date of Patent: May 17, 2022

(54) SAFE HARBOR LOCI

(71) Applicant: Arsenal Biosciences, Inc., South San Francisco, CA (US)

(72) Inventors: Xinying Zheng, San Jose, CA (US); Brendan Galvin, San Bruno, CA (US); Somya Khare, Saratoga, CA (US); Aaron Cooper, Berkeley, CA (US); Michelle Nguyen, San Francisco, CA (US); Anzhi Yao, San Francisco, CA (US)

(73) Assignee: ARSENAL BIOSCIENCES, INC., South San Francisco, CA (US)

( * ) Notice: Subject to any disclaimer, the term of this patent is extended or adjusted under 35 U.S.C. 154(b) by 0 days.

(21) Appl. No.: 17/239,484

(22) Filed: Apr. 23, 2021

Related U.S. Application Data

(60) Provisional application No. 63/141,926, filed on Jan. 26, 2021, provisional application No. 63/105,834, filed on Oct. 26, 2020.

(51) Int. Cl.
| | |
|---|---|
| *A61K 35/17* | (2015.01) |
| *C12N 15/113* | (2010.01) |
| *C12N 5/0783* | (2010.01) |
| *C12N 15/11* | (2006.01) |
| *C12N 9/22* | (2006.01) |
| *C12N 15/85* | (2006.01) |

(52) U.S. Cl.
CPC .......... *C12N 15/1136* (2013.01); *A61K 35/17* (2013.01); *C12N 5/0636* (2013.01); *C12N 9/22* (2013.01); *C12N 15/111* (2013.01); *C12N 15/85* (2013.01); *C12N 2310/20* (2017.05)

(58) Field of Classification Search
CPC ....... C12N 15/85; C12N 9/22; C12N 2310/20
See application file for complete search history.

(56) References Cited

U.S. PATENT DOCUMENTS

| | | | |
|---|---|---|---|
| 8,697,359 | B1 | 4/2014 | Zhang |
| 9,290,748 | B2 | 3/2016 | Danos et al. |
| 2007/0083334 | A1 | 4/2007 | Mintz et al. |
| 2007/0161031 | A1 | 7/2007 | Trinklein et al. |
| 2016/0143953 | A1 | 5/2016 | Gregory et al. |
| 2017/0175128 | A1 | 6/2017 | Welstead et al. |
| 2017/0362635 | A1 | 12/2017 | Chamberlain et al. |
| 2018/0127786 | A1 | 5/2018 | Bouchon et al. |
| 2019/0185849 | A1 | 6/2019 | Lundberg et al. |

FOREIGN PATENT DOCUMENTS

| | | |
|---|---|---|
| WO | 2019/169233 A1 | 9/2019 |

OTHER PUBLICATIONS

Li et al.; Functional dissection of NEAT1 using genome editing reveals substantial localization of the NEAT1_1 isoform outside paraspeckles; RNA, vol. 23, pp. 872-881, Mar. 21, 2017 (Year: 2017).*

Aznauryan et al., "Discovery and Validation of Novel Human Genomic Safe Harbor Sites for Gene and Cell Therapies," https://doi.org/10.1101/2021.03.04.433856, Mar. 5, 2021, pp. 1-28.

Dobin et al., "STAR: Ultrafast Universal RNA-seq Aligner," Bioinformatics, vol. 29, No. 1, 2013, pp. 15-21.

Eyquem et al., "Targeting a CAR to the TRAC Locus with CRISPR/Cas9 Enhances Tumour Rejection," Letter, Nature, Mar. 2, 2017, vol. 543, pp. 113-131.

Irion et al., Identification and Targeting of the ROSA26 Locus in Human Embryonic Stem Cells, Nature Biotechnology, 25(12), 2007, pp. 1477-1482.

Kolb et al., "Site-Directed Genome Modification: Nucleic Acid and Protein Modules for Targeted Integration and Gene Correction," Tends in Biotechnology, vol. 23, Issue 8, Aug. 2005, pp. 399-406.

Kolde et al., "Robust Rank Agregation for Gene List Integration and Meta-Analysis," Bioinformatics, vol. 28, Issue 4, Feb. 15, 2012, pp. 573-580.

Listgarten et al., "Prediction of Off-Target Activities for the End-to-End Design of CRISPR Guide RNAs," Nat Biomed Eng. Jan. 2018, vol. 2, No. 1, pp. 38-47.

Nobles et al., "iGUIDE: An Improved Pipeline for Analyzing CRISPR Cleavage Specificity," Genome Biology, 2019, pp. 1-6.

Papapetrou et al., "Gene Insertion into Genomic Safe Harbors for Human Gene Therapy," Molecular Therapy, vol. 24, No. 4, Apr. 2016, pp. 678-684.

Paques et al., "Meganucleases and DNA Double-Strand Break-Induced Recombination: Perspectives for Gene Therapy," Current Gene Therapy 2007 7:49-66.

Pellenz et al., "New Human Chromosomal Sites with 'Safe Harbor' Potential for Targeted Transgene Insertion," Human Sene Therapy, 30(7), 2019, pp. 814-828.

Porteus et al., "Gene Targeting Using Zinc Finger Nucleases," Nat Biotechnol. 23, 2005 23, pp. 967-973.

Roth, T. L., et al., "Rapid Discovery of Synthetic DNA Sequences to Rewrite Endogenous T Cell Circuits," Apr. 12, 2019, bioRxiv, 604561, 55 pages.

Sadelain, M., Papapetrou, E. P., & Bushman, F. D., "Safe Harbours for the Integration of new DNA in the Human Genome," Nature Reviews—Cancer, 12(1 ), 51-58.

Suzuki et al., "In Vivo Genome Editing Via CRISPR/Cas9 Mediated Homology-Independent Targeted Integration," Nature, 2016, 540(7631), pp. 144-149.

Wallen, Mark C., Thomas Gaj, and Carlos F. Barbas III. "Redesigning recombinase specificity for safe harbor sites in the human genome." PloS one 10.9 (2015): e0139123, pp. 1-16.

(Continued)

*Primary Examiner* — Antonio Galisteo Gonzalez
(74) *Attorney, Agent, or Firm* — Goodwin Procter LLP

(57) ABSTRACT

Provided herein are safe harbor loci and methods for identifying and using safe harbor loci to engineer cells to express transgenes. The safe harbor loci exhibit increased transgene knock-in efficiency and allow for increased, stable expression of transgenes in engineered cells. Guide ribonucleic acids (gRNAs) may be used for insertion of transgenes in the safe harbor loci.

30 Claims, 72 Drawing Sheets

Specification includes a Sequence Listing.

(56) References Cited

OTHER PUBLICATIONS

International Search Report and Written Opinion for International Application No. PCT/US2021/056689 dated Mar. 2, 2022, 19 pages.

* cited by examiner

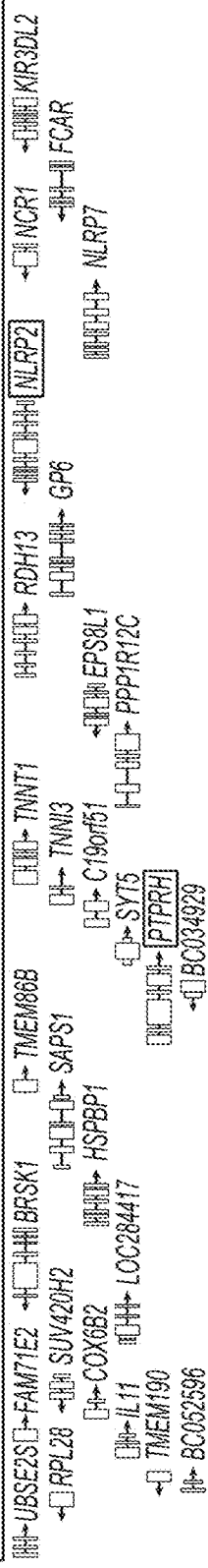
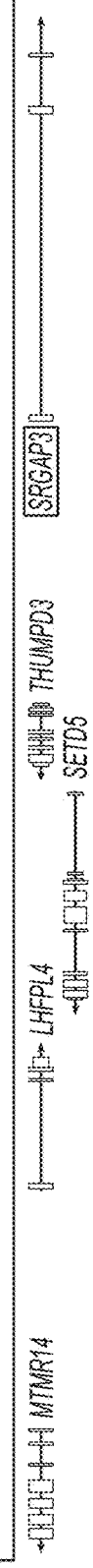
FIG. 2A
FIG. 2B
FIG. 2C

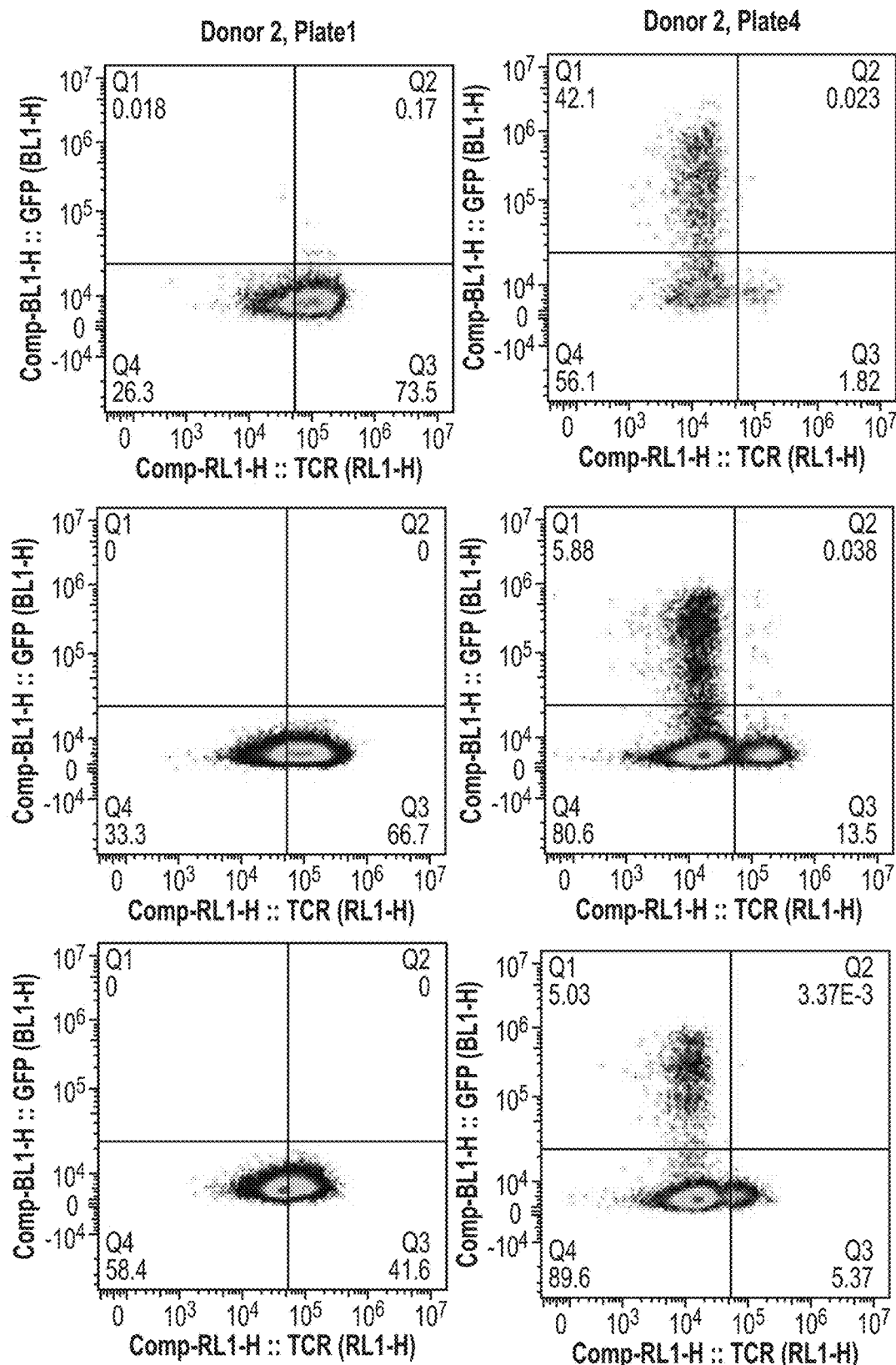
FIG. 20 (Cont. 1)

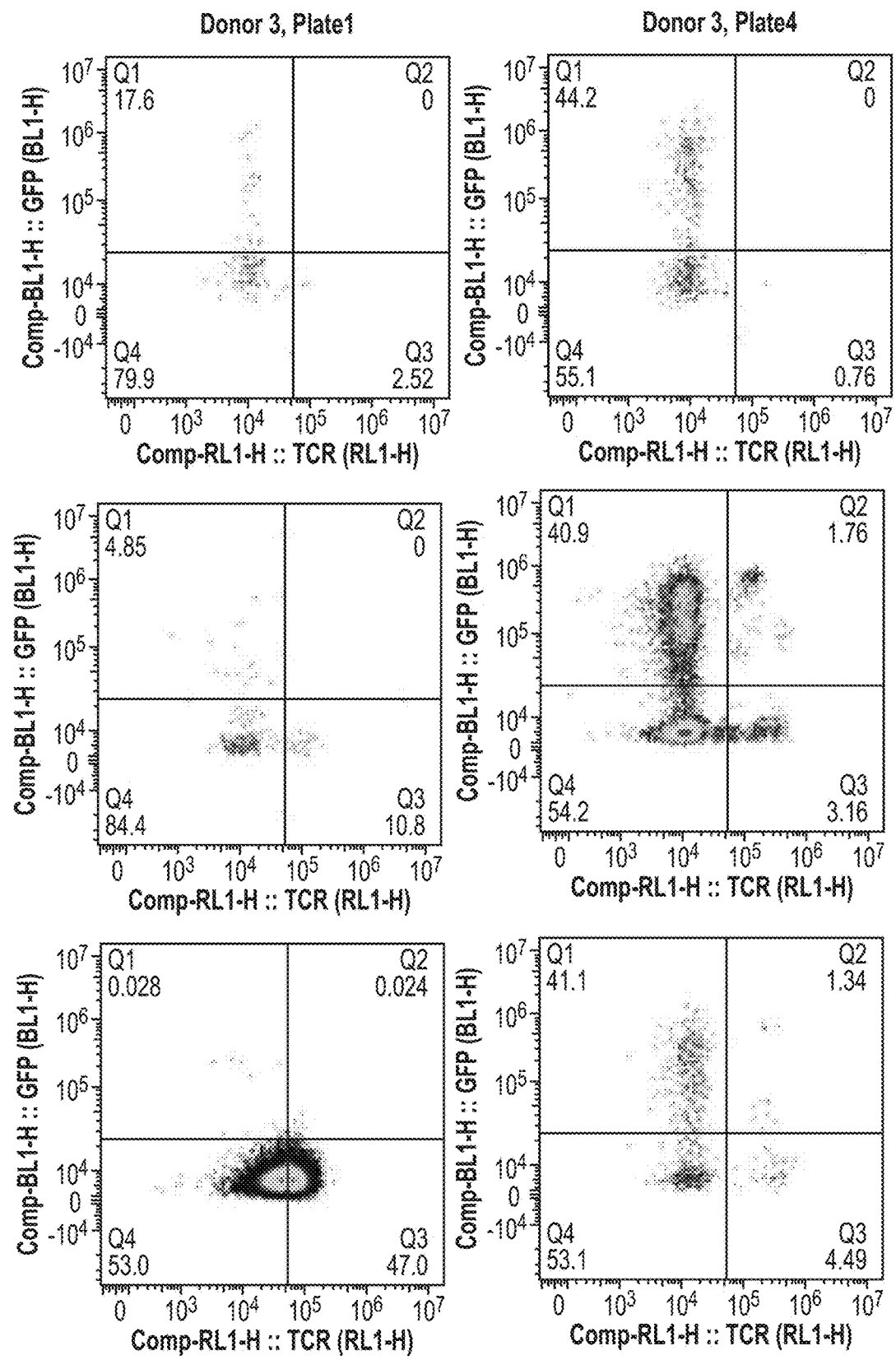
FIG. 20 (Cont. 2)

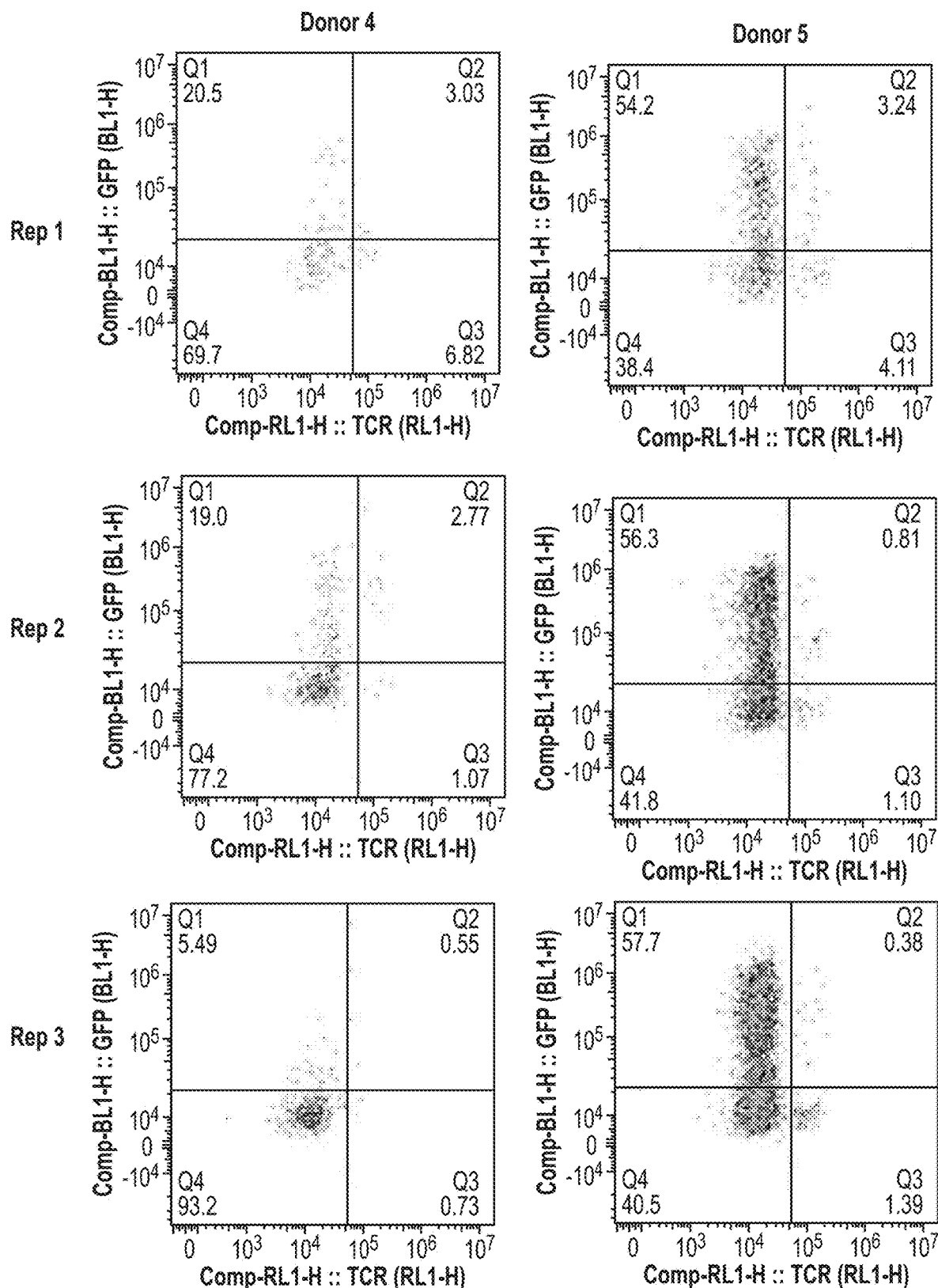
FIG. 20 (Cont. 3)

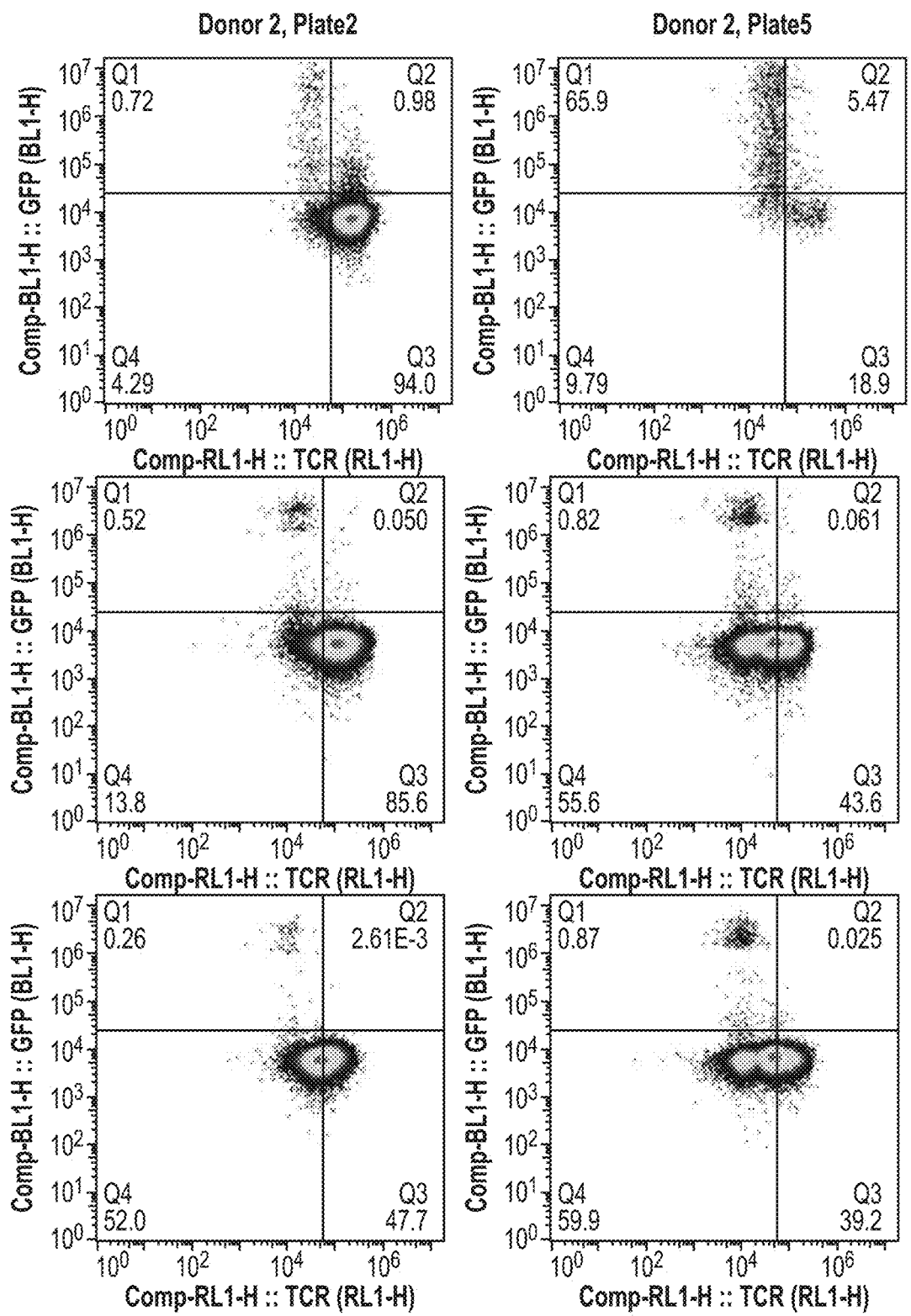
FIG. 21 (Cont. 1)

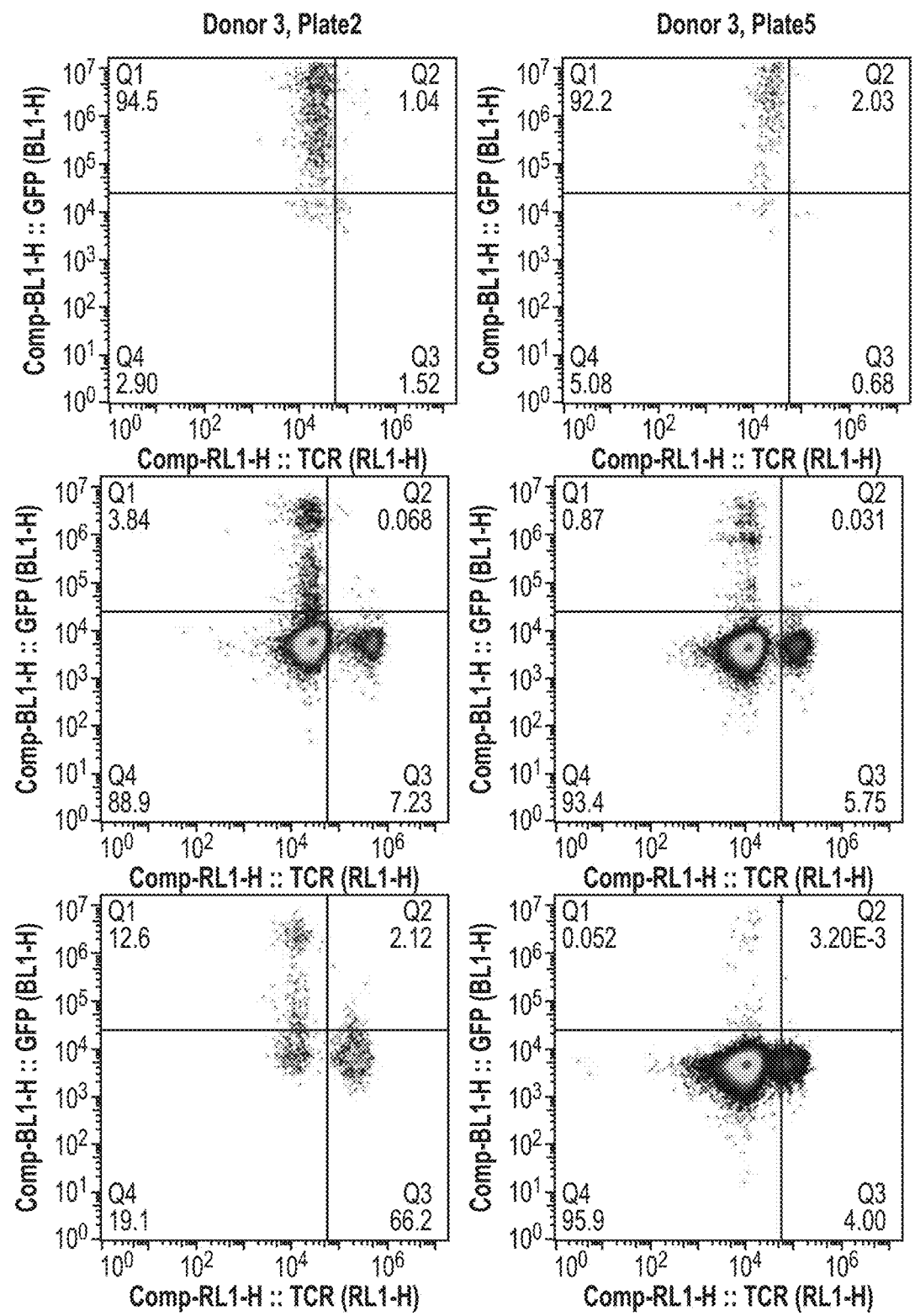
FIG. 21 (Cont. 2)

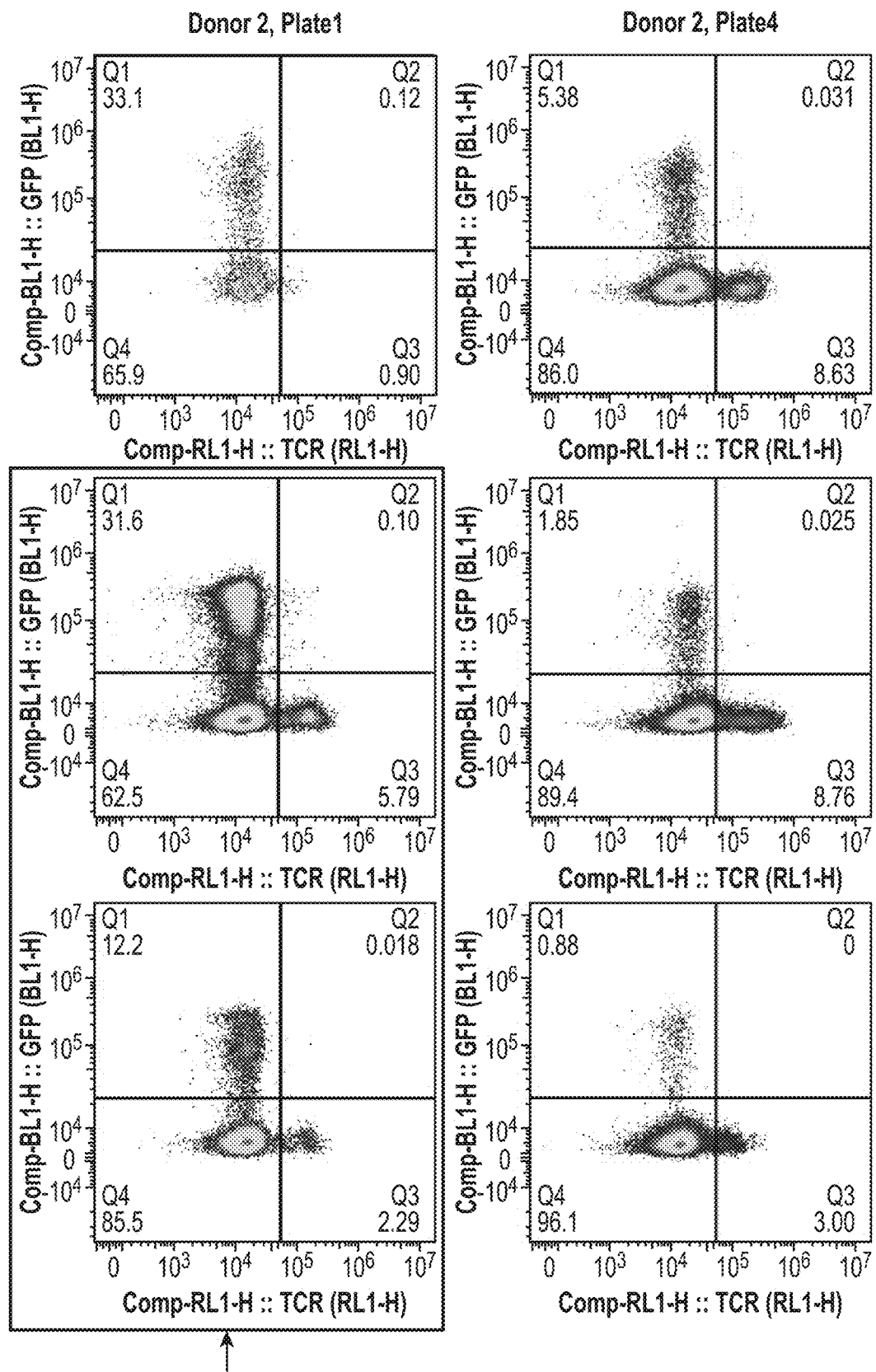
FIG. 24 (Cont. 1)

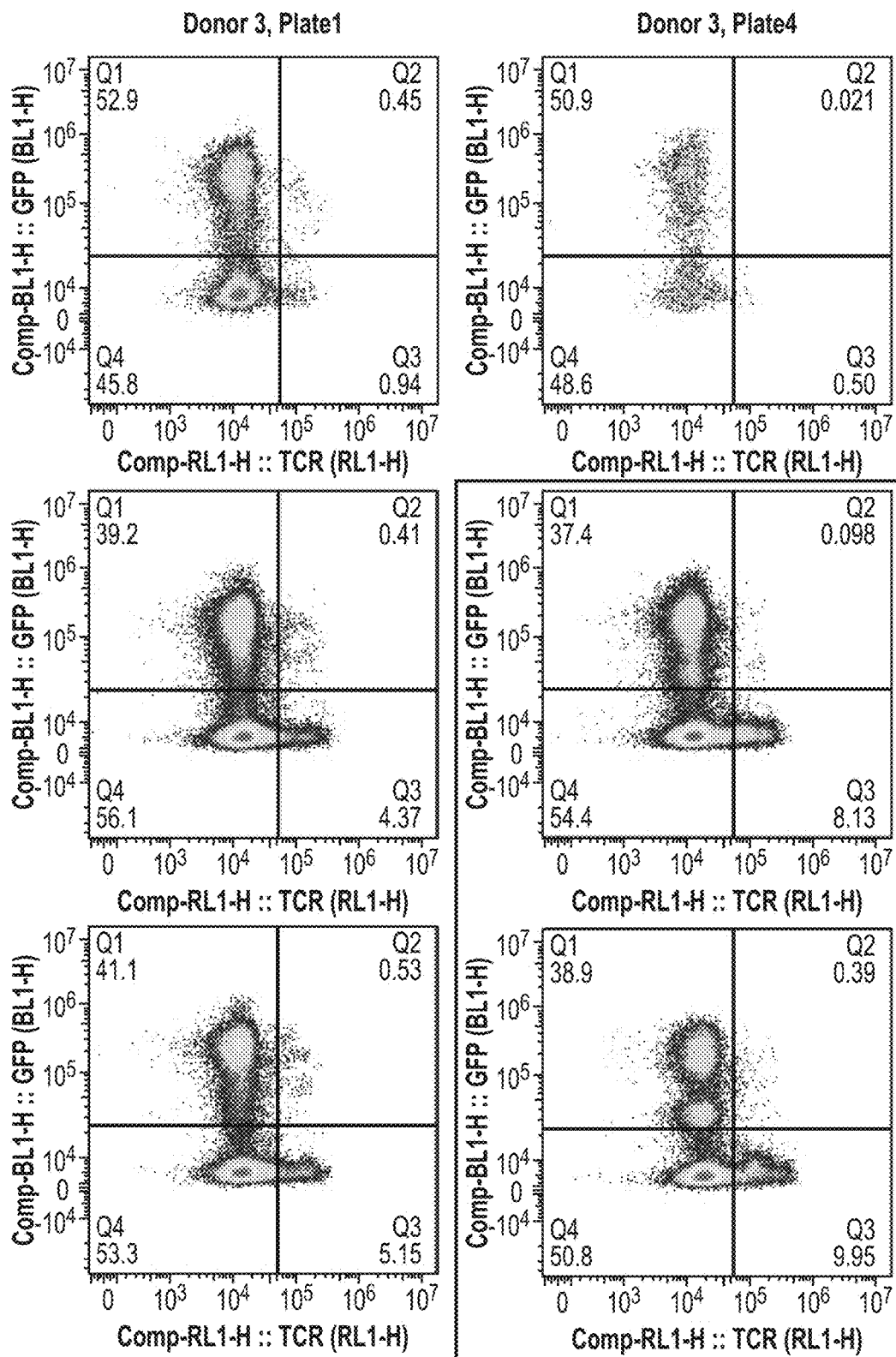
FIG. 24 (Cont. 2)

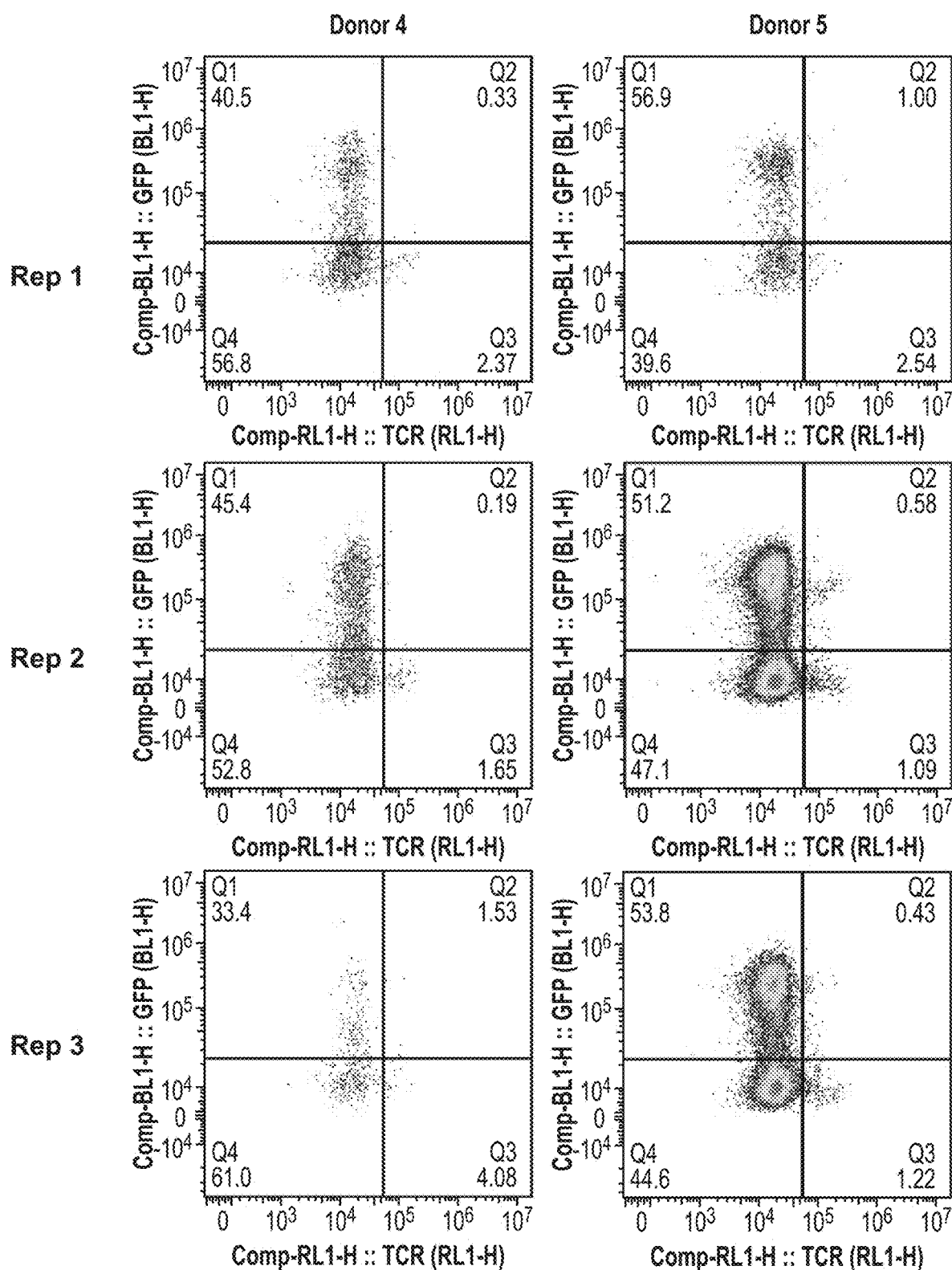
FIG. 24 (Cont. 3)

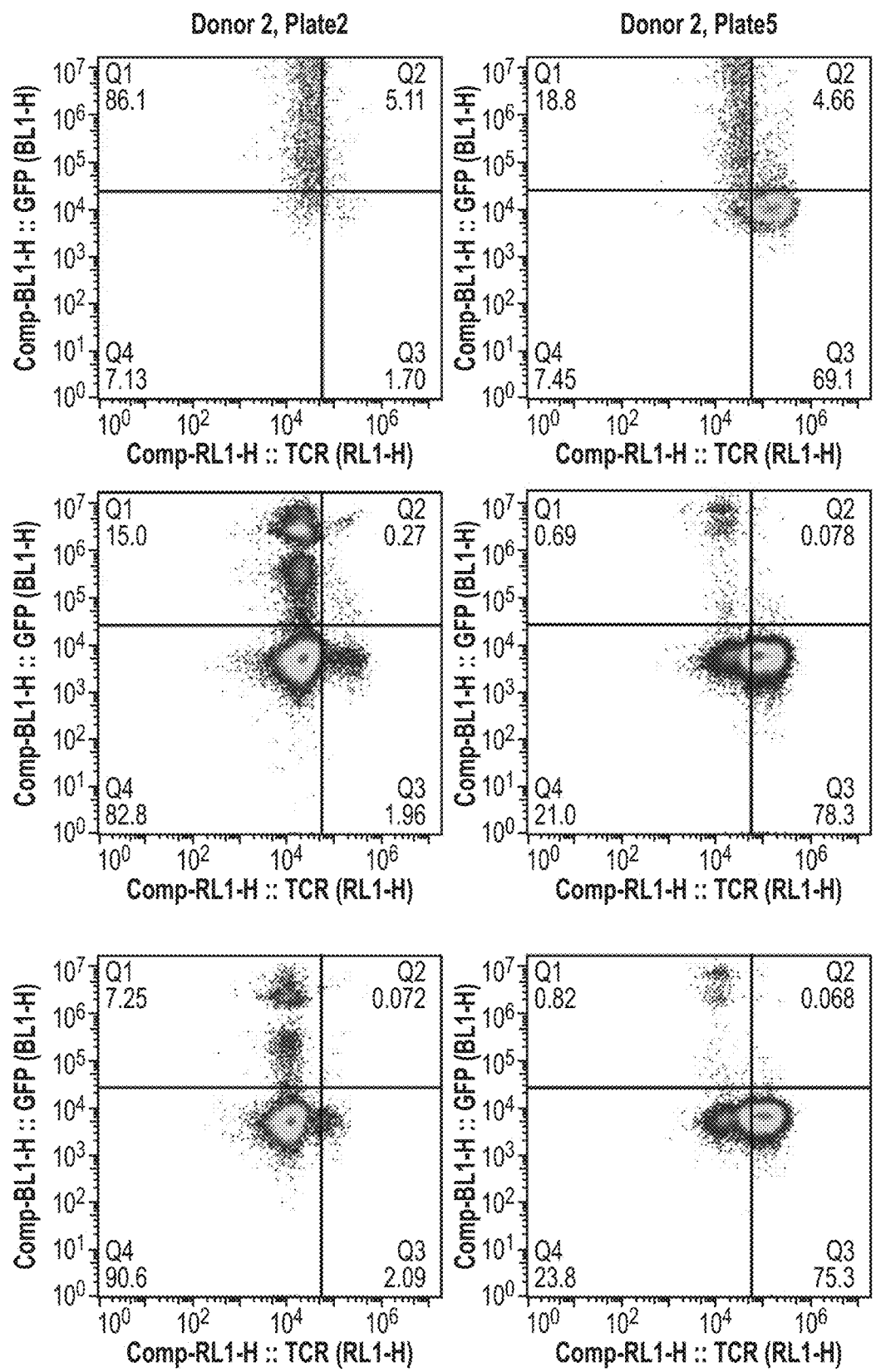
FIG. 25 (Cont. 1)

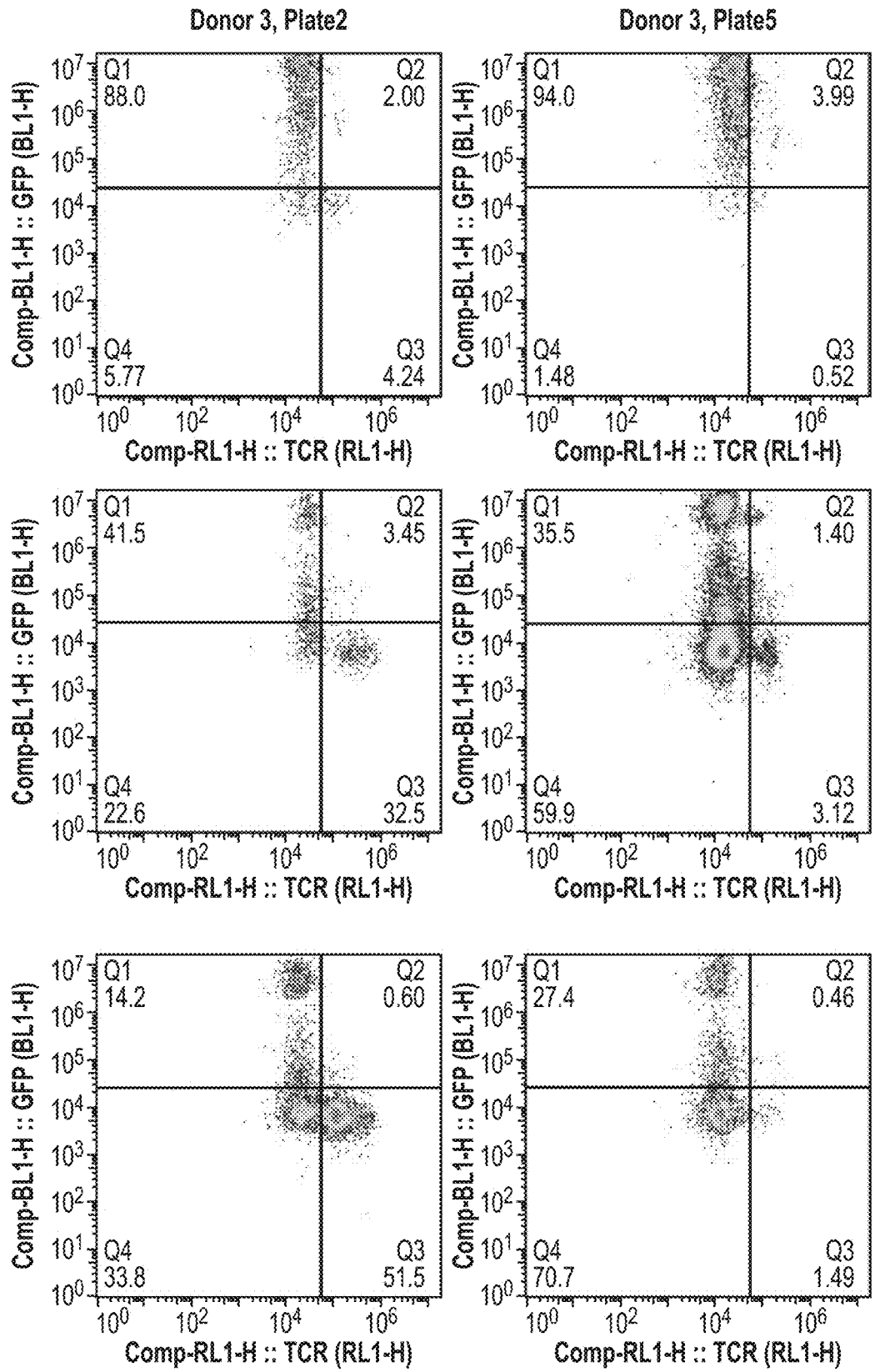
FIG. 25 (Cont. 2)

iGUIDE-seq 20pm 96W sgRNA_94 (G)
Target: sgRNA_94

| GAGCCATGCTTGGCTTACGANGG | Mismatch | Target | Abund. | MESL | Gene_ID |
|---|---|---|---|---|---|
| .....................G... | 0 | On | 2,336 | 95.1 | ETS1~ |
| A.T.....T..C....T.C.TA. | 6 | Off | 7 | 23.9 | RNU6-259P |
| C......A....GC.C.T.T.C | 6 | Off | 5 | 32.3 | RN7SKP254 |
| ..TGA....A......CA..T.. | 6 | Off | 5 | 23.7 | CYCSP17 |
| .T...T....A.TT...A..T.. | 6 | Off | 4 | 95.1 | RNU4-8P |
| ..A..C.....G.....C.C.TTA. | 6 | Off | 4 | 36.6 | TBC1D14* |
| .T...TCC........G.A..G.C | 6 | Off | 4 | 35.4 | MDFI* |
| ..........A...TGCC..C.GT. | 6 | Off | 3 | 32.3 | LOC101928823* |
| CCT...........GGC.T.A | 6 | Off | 3 | 30.0 | MYBBP1A*~ |
| ...TA..A.....C.GC.GT. | 6 | Off | 3 | 29.4 | HSPD1P15 | iGUIDE-seq 20pm 96W sgRNA_94 (Donor 2) (G)
Target: sgRNA_94

| GAGCCATGCTTGGCTTACGANGG | Mismatch | Target | Abund | MESL | Gene_ID |
|---|---|---|---|---|---|
| .....................G... | 0 | On | 2,164 | 95.5 | ETS1~ |
| ......G.GAG.....C.C.GA. | 6 | Off | 4 | 37.3 | ZFPM1* |
| .T.A..T...TA.....C.CA. | 6 | Off | 2 | 27.3 | OR6D1P |
| ......G......GC.CA.GT.C | 6 | Off | 2 | 25.2 | NPHP4* |
| ......GTG....GAG....TT. | 6 | Off | 1 | 80.5 | ELN~ |
| A.....GAT...A..T...A.T | 6 | Off | 1 | 56.9 | RAPGEF4* |
| C.........CT..A..T.CA.T | 6 | Off | 1 | 43.2 | TMEM181* |
| ...G..G.T...C....A.CA.T | 6 | Off | 1 | 37.3 | LDHD |
| ..CA.....C.T..A..T.AA. | 6 | Off | 1 | 37.3 | LINC01392 |
| C...AG..A.G....C....C.. | 6 | Off | 1 | 32.6 | C14orf180 |

FIG. 39C

SAFE HARBOR LOCI

CROSS REFERENCE TO RELATED APPLICATIONS

This application claims priority to and the benefit of U.S. Provisional Patent Application No. 63/141,926, filed on Jan. 26, 2021, and U.S. Provisional Patent Application No. 63/105,834, filed on Oct. 26, 2020, the entire contents of which are incorporated by reference herein for all purposes.

SEQUENCE LISTING

The instant application contains a Sequence Listing which will be submitted via EFS-Web and is hereby incorporated by reference in its entirety. Said ASCII copy, created on Apr. 28, 2021, is named ANB-203US_SL.txt and is 623,177 bytes in size.

BACKGROUND

Cancer continues to present a significant clinical burden despite the substantial research efforts and scientific advances in cancer therapies. Blood and bone marrow cancers are frequently diagnosed cancer types, including multiple myelomas, leukemia, and lymphomas. Current treatment options for these cancers are not effective for all patients and/or can have substantial adverse side effects. Other types of cancer also remain challenging to treat using existing therapeutic options. Cancer immunotherapies are a promising solution because they can be highly specific, allowing for increased therapeutic effectiveness and the mitigation of side effects.

Genetically engineered immune cell therapy is a growing field with promising applications for the treatment of diseases including, but not limited to, cancer. Through the alteration of coding and/or non-coding genomic regions, researchers are identifying transgenes and insertion sites within cells that facilitate, for example, enhanced cell function, arrest cell growth, induced cell death, and tumor size/volume reduction. The identification of safe harbor sites (SHS) has improved outcomes of genome-engineering therapies. Well known SHS include the AAVS1 adeno-associated virus insertion site on chromosome 19, the human homolog of the murine Rosa26 locus, and the CCR5 chemokine receptor gene—the absence of which confers HIV resistance. (See, for example, Pellenz et al., 2018, the relevant disclosures of which are herein incorporated by reference). However, there is still a need for improved guidelines for gene editing therapies and additional SHS to address challenges such as poor knock-in (KI) efficiency, insertional oncogenesis, unstable and/or anomalous expression of transgenes and/or adjacent genes, etc.

SUMMARY

The present disclosure is directed, inter alia, to safe harbor loci that exhibit high knock-in efficiency and stable expression of their transgenes. These safe harbor loci can be used to alter T cells for immunotherapy. These safe harbor loci are useful for the treatment of various diseases, including cancer.

In one aspect, the present disclosure provides an engineered cell, comprising at least one sequence encoding a transgene, wherein the at least one sequence is inserted within a safe harbor locus, the safe harbor locus is at any one or more of the sgRNA target loci provided in Table 4; and wherein expression of the at least one sequence encoding the transgene is operatively linked to an endogenous promoter. In another aspect, the present disclosure provides an engineered cell, comprising at least one sequence encoding a transgene, wherein the at least one sequence is inserted within a safe harbor locus, the safe harbor locus is at any one or more of the sgRNA target loci provided in Table 4; and wherein expression of the at least one sequence encoding the transgene is operatively linked to an exogenous promoter.

In some embodiments, the target locus is selected from: chr10:33130000-33140000, chr10:72290000-72300000, chr11:128340000-128350000, chr11:65425000-65427000 (NEAT1), chr15:92830000-92840000, chr16:11220000-11230000, chr2:87460000-87470000, chr3:186510000-186520000, chr3:59450000-59460000, chr8:127980000-128000000, and chr9:7970000-7980000. In some embodiments, the target locus is selected from: chr10:72290000-72300000, chr11:128340000-128350000, chr15:92830000-92840000, and chr16:11220000-11230000. In some embodiments, the target locus is chr11:128340000-128350000. In some embodiments, the target locus is chr15:92830000-92840000. In some embodiments, the target locus is a gene selected from: APRT, B2M, CAPNS1, CBLB, CD2, CD3E, CD3G, CD5, EDF1, FTL, PTEN, PTPN2, PTPN6, PTPRC, PTPRCAP, RPS23, RTRAF, SERF2, SLC38A1, SMAD2, SOCS1, SRP14, SRSF9, SUB1, TET2, TIGIT, TRAC, and TRIM28.

In some embodiments, the safe harbor locus is selected from any one of the integration sites in Table 4 designated: GS88, GS89, GS90, GS91, GS92, GS93, GS94, GS95, GS96, GS97, GS98, GS99, GS100, GS101, GS102, GS103, GS104, GS105, GS106, GS107, GS108, GS109, GS110, GS111, GS112, GS113, GS114, GS115, GS116, GS117, GS118, GS119, GS120. In some embodiments, the safe harbor locus is selected from any one of the integration sites in Table 4 designated: GS91, GS92, GS93, GS94, GS95, GS96, GS100, GS101, GS102, GS103, GS104, and GS105. In some embodiments, the safe harbor locus is selected from any one of the integration sites in Table 4 designated: GS103, GS104, and GS105. In some embodiments, the safe harbor locus is selected from any one of the integration sites in Table 4 designated: GS94, GS95, and GS96. In some embodiments, the safe harbor locus is the GS94 integration site in Table 4. In some embodiments, the safe harbor locus is selected from any one of the integration sites in Table 4 designated: GS100, GS101, and GS102. In some embodiments, the safe harbor locus is the GS102 integration site in Table 4. In some embodiments, the safe harbor locus is selected from any one of the integration sites in Table 4 designated: GS91, GS92, and GS93.

In some embodiments, the exogenous promoter is an EF1a promoter. In some embodiments, the engineered cell is a stem cell, a human cell, a primary cell, an hematopoietic cell, an adaptive immune cell, an innate immune cell, a T cell or a T cell progenitor. In some embodiments, the transgene encodes a recombinant protein, optionally a therapeutic agent. In some embodiments, the transgene encodes a chimeric antigen receptor (CAR).

In another aspect, the present disclosure provides a composition comprising the engineered cell as described herein and a pharmaceutical excipient.

In another aspect, the present disclosure provides a guide ribonucleic acids (gRNA) for editing a cell at a safe harbor locus, wherein gRNA comprises any one of the sgRNA sequences in Table 4.

In some embodiments, the gRNA comprises any one of SEQ ID NOS:1-120. In some embodiments, the gRNA comprises any one of SEQ ID NOS: 91-96 and 100-105. In some embodiments, the gRNA comprises SEQ ID NO:94 or SEQ ID NO:102. In some embodiments, the gRNA comprises SEQ ID NO:94. In some embodiments, the gRNA comprises SEQ ID NO:102. In some embodiments, the cell is a stem cell, a human cell, a primary cell, an hematopoietic cell, an adaptive immune cell, an innate immune cell, a T cell or a T cell progenitor.

In another aspect, the present disclosure provides a method of editing a cell having chromosomal DNA, comprising inserting at least one sequence encoding a transgene within a safe harbor locus in the chromosomal DNA of the cell, wherein the safe harbor locus is any one or more of the sgRNA target loci provided in Table 4.

In some embodiments, the target locus is selected from: chr10:33130000-33140000, chr10:72290000-72300000, chr11:128340000-128350000, chr11:65425000-65427000 (NEAT1), chr15:92830000-92840000, chr16:11220000-11230000, chr2:87460000-87470000, chr3:186510000-186520000, chr3:59450000-59460000, chr8:127980000-128000000, and chr9:7970000-7980000. In some embodiments, the target locus is selected from: chr10:72290000-72300000, chr11:128340000-128350000, chr15:92830000-92840000, and chr16:11220000-11230000. In some embodiments, the target locus is chr11:128340000-128350000. In some embodiments, the target locus is chr15:92830000-92840000. In some embodiments, the target locus is a gene selected from: APRT, B2M, CAPNS1, CBLB, CD2, CD3E, CD3G, CD5, EDF1, FTL, PTEN, PTPN2, PTPN6, PTPRC, PTPRCAP, RPS23, RTRAF, SERF2, SLC38A1, SMAD2, SOCS1, SRP14, SRSF9, SUB1, TET2, TIGIT, TRAC, and TRIM28.

In some embodiments, the safe harbor locus is selected from any one of the integration sites in Table 4 designated: GS88, GS89, GS90, GS91, GS92, GS93, GS94, GS95, GS96, GS97, GS98, GS99, GS100, GS101, GS102, GS103, GS104, GS105, GS106, GS107, GS108, GS109, GS110, GS111, GS112, GS113, GS114, GS115, GS116, GS117, GS118, GS119, GS120. In some embodiments, the safe harbor locus is selected from any one of the integration sites in Table 4 designated: GS91, GS92, GS93, GS94, GS95, GS96, GS100, GS101, GS102, GS103, GS104, and GS105. In some embodiments, the safe harbor locus is selected from any one of the integration sites in Table 4 designated: GS103, GS104, and GS105. In some embodiments, the safe harbor locus is selected from any one of the integration sites in Table 4 designated: GS94, GS95, and GS96. In some embodiments, the safe harbor locus is the GS94 integration site in Table 4. In some embodiments, the safe harbor locus is selected from any one of the integration sites in Table 4 designated: GS100, GS101, and GS102. In some embodiments, the safe harbor locus is the GS102 integration site in Table 4. In some embodiments, the safe harbor locus is selected from any one of the integration sites in Table 4 designated: GS91, GS92, and GS93.

In some embodiments, the transgene encodes a recombinant protein, optionally a therapeutic agent. In some embodiments, the transgene encodes a chimeric antigen receptor (CAR). In some embodiments, the at least one sequence comprises an exogenous promoter and the exogenous promoter is operably linked to the transgene. In some embodiments, the exogenous promoter is an EF1a promoter. In some embodiments, the cell is a stem cell, a human cell, a primary cell, an hematopoietic cell, an adaptive immune cell, an innate immune cell, a T cell or T cell progenitor. In some embodiments, the at least one sequence is inserted using a homology-directed repair. In some embodiments, the at least one sequence is inserted using a homology independent targeted insertion. In some embodiments, the at least one sequence is inserted using one or more guide ribonucleic acids (gRNAs) and one or more Cas9 endonucleases.

In some embodiments, the one or more gRNAs comprises any one of SEQ ID NOS: 1-120. In some embodiments, the one or more gRNAs comprises any one of SEQ ID NOS: 91-96 and 100-105. In some embodiments, the gRNA comprises SEQ ID NO:94 or SEQ ID NO:102. In some embodiments, the gRNA comprises SEQ ID NO:94. In some embodiments, the gRNA comprises SEQ ID NO:102.

In another aspect, the present disclosure provides a method of editing a T cell, comprising contacting a T cell with one or more guide ribonucleic acids (gRNAs), at least one sequence encoding a transgene, and one or more Cas9 endonucleases, wherein the one or more gRNAs and Cas9 endonucleases facilitate the insertion of the at least one sequence into chromosomal DNA within a safe harbor locus, wherein the safe harbor locus is selected from any one or more of the sgRNA target loci in Table 4.

In some embodiments, the one or more gRNAs comprises a sequence selected from any one of the sgRNA sequences in Table 4. In some embodiments, the one or more gRNAs comprises any one of SEQ ID NOS: 1-120. In some embodiments, the one or more gRNAs comprises any one of SEQ ID NOS: 91-96 and 100-105. In some embodiments, the gRNA comprises SEQ ID NO:94 or SEQ ID NO:102. In some embodiments, the gRNA comprises SEQ ID NO:94. In some embodiments, the gRNA comprises SEQ ID NO:102.

In some embodiments, the target locus is selected from: chr10:33130000-33140000, chr10:72290000-72300000, chr11:128340000-128350000, chr11:65425000-65427000 (NEAT1), chr15:92830000-92840000, chr16:11220000-11230000, chr2:87460000-87470000, chr3:186510000-186520000, chr3:59450000-59460000, chr8:127980000-128000000, and chr9:7970000-7980000. In some embodiments, the target locus is selected from: chr10:72290000-72300000, chr11:128340000-128350000, chr15:92830000-92840000, and chr16:11220000-11230000. In some embodiments, the target locus is chr11:128340000-128350000. In some embodiments, the target locus is chr15:92830000-92840000. In some embodiments, the target locus is a gene selected from: APRT, B2M, CAPNS1, CBLB, CD2, CD3E, CD3G, CD5, EDF1, FTL, PTEN, PTPN2, PTPN6, PTPRC, PTPRCAP, RPS23, RTRAF, SERF2, SLC38A1, SMAD2, SOCS1, SRP14, SRSF9, SUB1, TET2, TIGIT, TRAC, and TRIM28.

In some embodiments, the safe harbor locus is selected from any one of the integration sites in Table 4 designated: GS88, GS89, GS90, GS91, GS92, GS93, GS94, GS95, GS96, GS97, GS98, GS99, GS100, GS101, GS102, GS103, GS104, GS105, GS106, GS107, GS108, GS109, GS110, GS111, GS112, GS113, GS114, GS115, GS116, GS117, GS118, GS119, GS120. In some embodiments, the safe harbor locus is selected from any one of the integration sites in Table 4 designated: GS91, GS92, GS93, GS94, GS95, GS96, GS100, GS101, GS102, GS103, GS104, and GS105. In some embodiments, the safe harbor locus is selected from any one of the integration sites in Table 4 designated: GS103, GS104, and GS105. In some embodiments, the safe harbor locus is selected from any one of the integration sites in Table 4 designated: GS94, GS95, and GS96. In some embodiments, the safe harbor locus is the GS94 integration site in Table 4. In some embodiments, the safe harbor locus is selected from any one of the integration sites in Table 4 designated: GS100, GS101, and GS102. In some embodiments, the safe harbor locus is the GS102 integration site in Table 4. In some embodiments, the safe harbor locus is selected from any one of the integration sites in Table 4 designated: GS91, GS92, and GS93

In another aspect, the present disclosure provides an ex vivo method of obtaining an engineered cell or population thereof, comprising (a) obtaining a cell; and (b) genetically modifying the cell by inserting at least one sequence encoding a transgene within a safe harbor locus, wherein the safe harbor locus is selected from any one of the sgRNA target loci in Table 4.

In some embodiments, obtaining the cell comprises: (i) collecting a tissue sample from a subject, (ii) isolating the cells from the tissue samples, and (iii) culturing the cells in vitro. In some embodiments, the tissue sample is a blood sample. In some embodiments, the cell is a stem cell, a human cell, a primary cell, an hematopoietic cell, an adaptive immune cell, an innate immune cell, a T cell or T cell precursor. In some embodiments, the at least one sequence is inserted using a homology-directed repair. In some embodiments, the at least one sequence is inserted using a homology independent targeted insertion.

In some embodiments, the genetically modifying in step (b) comprises contacting the cell with one or more guide ribonucleic acids (gRNAs), the at least one sequence, and one or more Cas9 endonucleases, wherein the one or more gRNAs and Cas9 endonucleases facilitate the insertion of the at least one sequence into chromosomal DNA within the safe harbor locus. In some embodiments, the one or more gRNAs comprises a sequence selected from any one of the sgRNA sequences in Table 4.

In some embodiments, the transgene encodes a recombinant protein, optionally a therapeutic agent. In some embodiments, the transgene encodes a chimeric antigen receptor (CAR). In some embodiments, the at least one sequence comprises an exogenous promoter and the exogenous promoter is operably linked to the transgene. In some embodiments, the exogenous promoter is an EF1a promoter.

In yet another aspect, the present disclosure provides a method of treating a subject having or at risk of having a disease, comprising administering to the subject an effective amount of an engineered cell as described herein, a population thereof, or a composition as described herein. In some embodiments, the cell, the population thereof, or the composition is administered to the subject by infusion.

In yet another aspect, the present disclosure provides a method of treating a subject having or at risk of having a disease, comprising (a) conducting any one of the methods described supra; and (b) administering to the subject an effective amount of a composition comprising the cell or a population thereof. In some embodiments, the composition is administered to the subject by infusion. In some embodiments, the disease is cancer. In some embodiments, the disease is blood cancer.

In another aspect, the present disclosure provides a method of identifying a safe harbor locus, comprising: (a) identifying genes or non-coding regions in a chromosome that are above a threshold level for expression across developmental cell states and/or a threshold level for accessibility of chromatin; (b) generating a linear model that correlates the gene or non-coding region from step (a) with knock-in (KI) efficiency and estimates the KI efficiency of any gene or coding region on the chromosome; and (c) selecting the safe harbor locus based on threshold parameters; wherein the safe harbor locus is selected for insertion of at least one sequence encoding a transgene within a cell.

In some embodiments, the threshold parameters include one or more of: stable expression of a transgene, knockout of the gene confers benefit to the function of the cell, no known function within the cell, stable transgene expression in vitro with or without CD3/CD28 stimulation, negligible off-target cleavage as detected by iGuide-Seq or CRISPR-Seq, less off-target cleavage relative to other loci as detected by iGuide-Seq or CRISPR-Seq, negligible transgene-independent cytotoxicity, negligible transgene-independent cytokine expression, negligible transgene-independent chimeric antigen receptor expression, negligible deregulation or silencing of nearby genes, and positioned outside of a cancer-related gene. In some embodiments, the stable expression of a transgene at the safe harbor locus is less than or equal to 2-fold expression change over the course of at least 1, 2, 3, 4, 5, 6, or 7 days, and wherein expression change is measured by mean fluorescence intensity of a reporter gene encoded by the at least one sequence. In some embodiments, the accessibility of chromatin is measured using an assay for transposase-accessible chromatin using sequencing (ATAC-seq). In some embodiments, the level of expression across developmental cell states is measured using RNA sequencing (RNA-seq).

In some embodiments, the cell is a stem cell, a human cell, a primary cell, an hematopoietic cell, an adaptive immune cell, an innate immune cell, a T cell or T cell precursor. In some embodiments, the linear model has a coefficient of determination ($R^2$ value) of at least 30%.

In yet another aspect, the present disclosure provides an engineered cell, composition, gRNA or method as described herein, wherein insertion within the safe harbor locus increase cell cytotoxicity of diseased cells.

In yet another aspect, the present disclosure provides an engineered cell, composition, gRNA or method as described herein, wherein knock-in efficiency at the safe harbor locus is increased relative to other locations along the chromosome.

BRIEF DESCRIPTION OF THE DRAWINGS

These and other features, aspects, and advantages of the present invention will become better understood with regard to the following description, and accompanying drawings, where:

FIGS. 2A-2C include schematic depicting 3 top safe harbor loci known in the art: AAVS1 (FIG. 2A), CCR5 (FIG. 2B), and Rosa26 (FIG. 2C). The figures were retrieved from Sadelain, M., et al. (2012). Safe harbours for the integration of new DNA in the human genome. Nature reviews Cancer, 12(1), 51-58, the relevant disclosures of which are herein incorporated by reference in their entirety.

FIG. 4A includes a heatmap of samples generated with processed RNA-seq data. FIG. 4B includes a heatmap sample generated with processed RNA-seq data, showing the clustering of ~20 k genes.

FIG. 5A includes a plot showing direct correlation between transcript expression data from Roth, T. L., et al. 2019 and transcript expression data generated by the inventors of the present disclosure. FIG. 5B includes a heatmap showing clusters of the top 10% expressed genes.

FIG. 31A includes a plot showing that the expression from the EF1a promoter was approximately 10 times higher than expression from an endogenous promoter. FIG. 31B shows the top KI loci ranked by GFP MFI at week 3. FIG. 31C shows the top integration loci ranked by GFP MFI (at weeks 3 and 4; donors 1-3).

In FIG. 38B, the PrimeR expression is normalized to the expression from using the TRAC integration site.

FIG. 39C includes schematics from the iGuide-Seq analysis showing that GS94 had no reproducible putative off-targets across two donors FIG. 39C discloses SEQ ID NOS 312-322, 312-313, and 323-331, respectively, in order of appearance.

DETAILED DESCRIPTION

The present disclosure provides safe harbor loci and methods for identifying safe harbor loci that exhibit high integration efficiency (e.g., high knock-in (KI) efficiency), high and constant levels of transgene expression, and such benefits independent of T cell activation/differentiation state. In some embodiments, the safe harbor loci also exhibit minimal to no disruption to T cell function and/or capacity for product manufacturing. In some embodiments, these loci are useful for effective and safe integration and expression of transgenes in T cells (e.g. in CAR T therapies). In some embodiments, the methods described herein can be used for the identification of safe harbor loci for insertion of transgenes in other types of cells.

Figure 1:
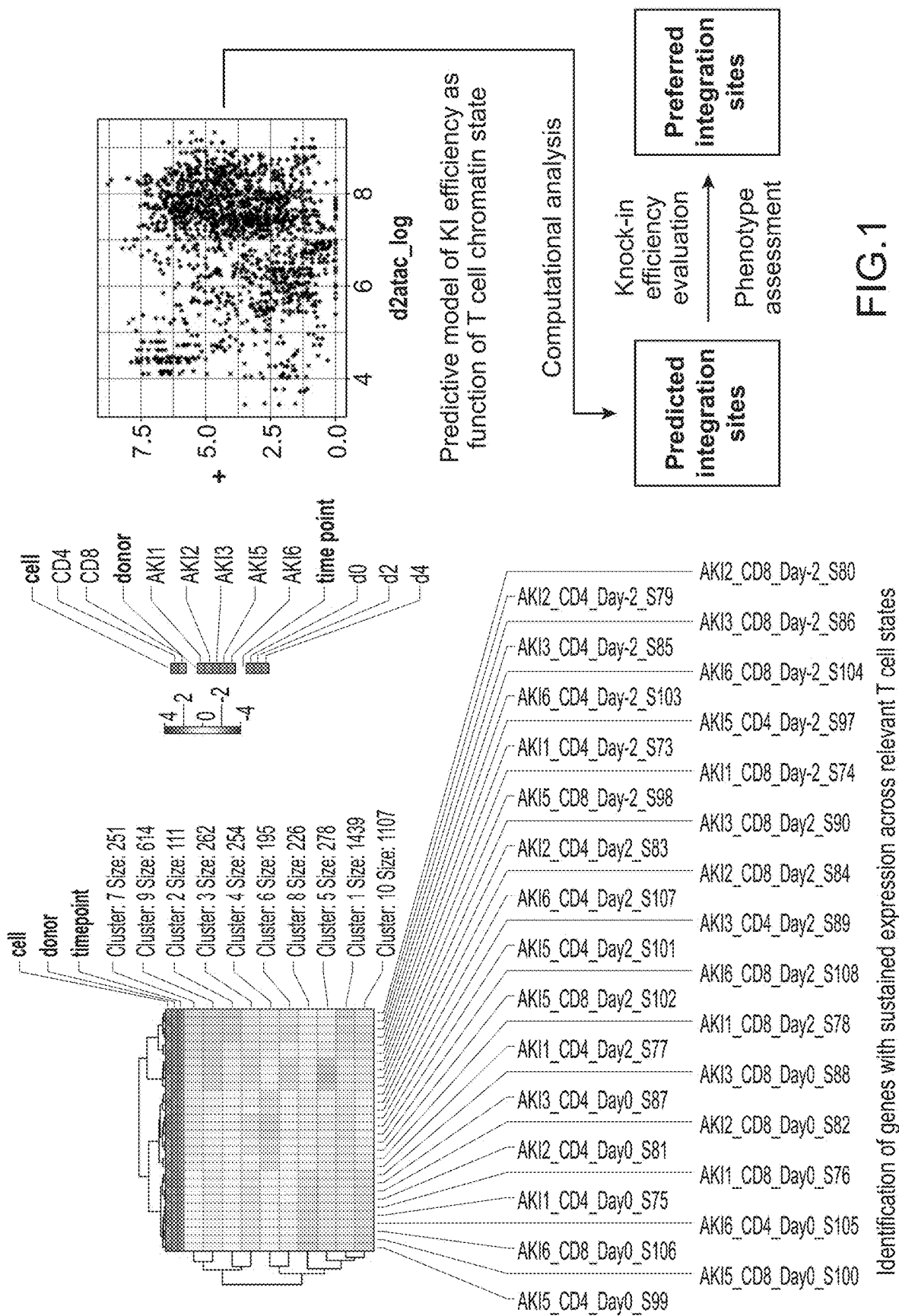
FIG. 1 includes a schematic depicting the methodology used to identify safe harbor loci in the present disclosure, in some embodiments.
Figure 1:
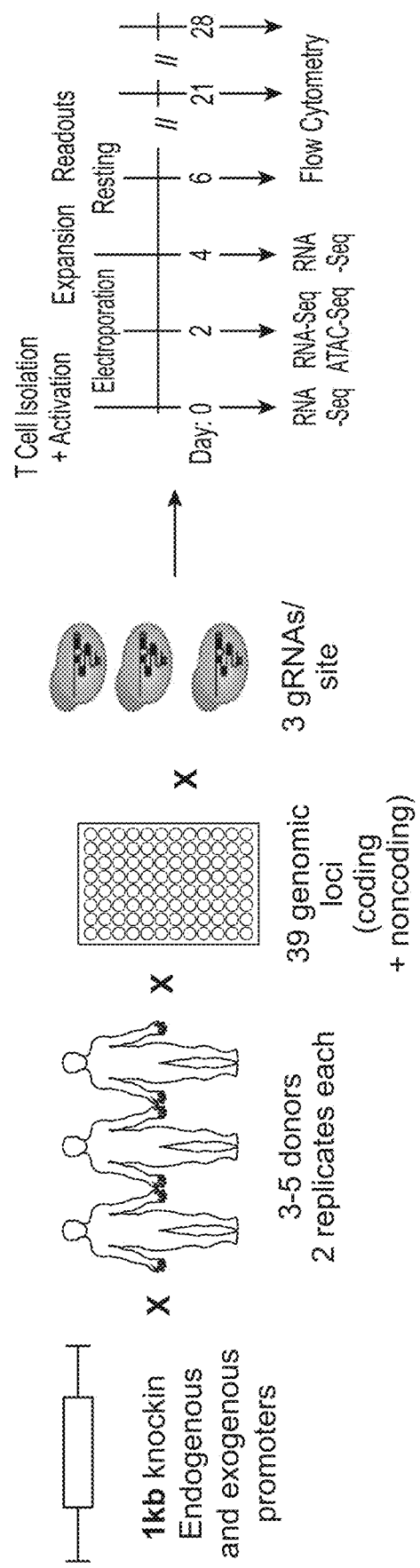

FIG. 1 illustrates the overall approach that the inventors of the present disclosure used to identify safe harbor loci. In some embodiments, the present disclosure provides a method comprising the identification of genes within a genome and non-coding regions with sustained expression in a treatment cell (e.g. T cell) and using a predictive model of KI efficiency as a function of T cell chromatic state and computational analysis to predict candidate integration sites. The method further comprises evaluating the candidate integration sites for actual KI efficiency, sustained levels of transgene expression of a transgene, and minimal disruption to the treatment cell phenotype (e.g., T cell function and/or capacity for treatment product expansion and manufacturing). In some embodiments, the safe harbor loci allow for integration of a transgene driven by an endogenous promoter. In some embodiments, the safe harbor loci allow for integration of a transgene driven by an exogenous promoter (e.g. EF1a promoter).

To facilitate an understanding of the present disclosure, a number of terms and phrases are defined below. Unless otherwise defined herein, scientific and technical terms used in this application shall have the meanings that are commonly understood by those of ordinary skill in the art. Generally, nomenclature used in connection with, and techniques of pharmacology, cell and tissue culture, molecular biology, cell and cancer biology, neurobiology, neurochemistry, virology, immunology, microbiology, genetics and protein and nucleic acid chemistry, described herein, are those well-known and commonly used in the art. In case of conflict, the present specification, including definitions, will control.

Unless otherwise defined, all terms of art, notations and other scientific terminology used herein are intended to have the meanings commonly understood by those of skill in the art. In some cases, terms with commonly understood meanings are defined herein for clarity and/or for ready reference, and the inclusion of such definitions herein should not necessarily be construed to represent a difference over what is generally understood in the art. The techniques and procedures described or referenced herein are generally well understood and commonly employed using conventional methodologies by those skilled in the art, such as, for example, the widely utilized molecular cloning methodologies described in Sambrook et al., *Molecular Cloning: A Laboratory Manual* 4th ed. (2012) Cold Spring Harbor Laboratory Press, Cold Spring Harbor, N.Y. As appropriate, procedures involving the use of commercially available kits and reagents are generally carried out in accordance with manufacturer-defined protocols and conditions unless otherwise noted.

As used herein, the singular forms "a," "an," and "the" include the plural referents unless the context clearly indicates otherwise. The terms "include," "such as," and the like are intended to convey inclusion without limitation, unless otherwise specifically indicated.

As used herein, the term "comprising" also specifically includes embodiments "consisting of" and "consisting essentially of" the recited elements, unless specifically indicated otherwise.

The term "about" indicates and encompasses an indicated value and a range above and below that value. In certain embodiments, the term "about" indicates the designated value ±10%, ±5%, or ±1%. In certain embodiments, where applicable, the term "about" indicates the designated value(s) ±one standard deviation of that value(s).

As used herein, the term "gene" refers to the basic unit of heredity, consisting of a segment of DNA arranged along a chromosome, which codes for a specific protein or segment of protein. A gene typically includes a promoter, a 5' untranslated region, one or more coding sequences (exons), optionally introns, a 3' untranslated region. The gene may further comprise a terminator, enhancers and/or silencers.

As used herein, the term "locus" refers to a specific, fixed physical location on a chromosome where a gene or genetic marker is located.

As used herein, the term "target locus" refers to a locus on a chromosome within which a safe harbor locus can be used for the insertion of a sequence. A target locus can consist of multiple potential safe harbor loci (integration sites). Examples of target loci are provided in Table 4, as sgRNA target loci. The notation used for the sgRNA target loci in Table 4 refers to the genomic region of the target locus, defined by the chromosome of the target locus and the coordinate range for that target locus. For example, chr10: 33130000-33140000 refers to a target locus on Chr10 (chromosome 10) starting from coordinate 33130000 and ending with coordinate 33140000.

The term "safe harbor locus" refers to a locus at which genes or genetic elements can be incorporated without disruption to expression or regulation of adjacent genes. These safe harbor loci are also referred to as safe harbor sites (SHS). As used herein, a safe harbor locus refers to an "integration site" or "knock-in site" at which a sequence encoding a transgene, as defined herein, can be inserted. In some embodiments the insertion occurs with replacement of a sequence that is located at the integration site. In some embodiments, the insertion occurs without replacement of a sequence at the integration site. Examples of integration sites contemplated are provided in Table 4.

As used herein, the term "insert" refers to a nucleotide sequence that is integrated (inserted) at a safe harbor site. The insert can be used to refer to the genes or genetic elements that are incorporated at the safe harbor site using, for example, homology-directed repair (HDR) CRISPR/Cas9 genome-editing or other methods for inserting nucleotide sequences into a genomic region known to those of ordinary skill in the art.

The "CRISPR/Cas" system refers to a widespread class of bacterial systems for defense against foreign nucleic acid. CRISPR/Cas systems are found in a wide range of eubacterial and archaeal organisms. CRISPR/Cas systems include type I, II, and III sub-types. Wild-type type II CRISPR/Cas systems utilize an RNA-mediated nuclease, Cas9 in complex with guide and activating RNA to recognize and cleave foreign nucleic acid. Guide RNAs having the activity of both a guide RNA and an activating RNA are also known in the art. In some cases, such dual activity guide RNAs are referred to as a small guide RNA (sgRNA).

Cas9 homologs are found in a wide variety of eubacteria, including, but not limited to bacteria of the following taxonomic groups: Actinobacteria, Aquificae, Bacteroidetes-Chlorobi, Chlamydiae-Verrucomicrobia, Chlroflexi, Cyanobacteria, Firmicutes, Proteobacteria, Spirochaetes, and Thermotogae. An exemplary Cas9 protein is the *Streptococcus pyogenes* Cas9 protein. Additional Cas9 proteins and homologs thereof are described in, e.g., Chylinksi, et al., RNA Biol. 2013 May 1; 10(5): 726-737; Nat. Rev. Microbiol. 2011 June; 9(6): 467-477; Hou, et al., Proc Natl Acad Sci USA. 2013 Sep. 24; 110(39):15644-9; Sampson et al., Nature. 2013 May 9; 497(7448):254-7; and Jinek, et al., Science. 2012 Aug. 17; 337(6096):816-21. The Cas9 nuclease domain can be optimized for efficient activity or enhanced stability in the host cell.

As used herein, the term "Cas9" refers to an RNA-mediated nuclease (e.g., of bacterial or archeal orgin, or derived therefrom). Exemplary RNA-mediated nucleases include the foregoing Cas9 proteins and homologs thereof, and include but are not limited to, CPF1 (See, e.g., Zetsche et al., Cell, Volume 163, Issue 3, p'759-771,22 Oct. 2015). Similarly, as used herein, the term "Cas9 ribonucleoprotein" complex and the like refers to a complex between the Cas9 protein, and a crRNA (e.g., guide RNA or small guide RNA), the Cas9 protein and a trans-activating crRNA (tracrRNA), the Cas9 protein and a small guide RNA, or a combination thereof (e.g., a complex containing the Cas9 protein, a tracrRNA, and a crRNA guide RNA).

As used herein, the terms "T lymphocyte" and "T cell" are used interchangeably and refer to cells that have completed maturation in the thymus, and identify certain foreign antigens in the body. The terms also refer to the major leukocyte types that have various roles in the immune system, including activation and deactivation of other immune cells. The T cell can be any T cell such as a cultured T cell, e.g., a primary T cell, or a T cell derived from a cultured T cell line, e.g., a Jurkat, SupT1, etc., or a T cell obtained from a mammal. The T cell can be a CD3+cell. The T cell can be any type of T cell, CD4+/CD8+double positive T cells, CD4+helper T cells (e.g. Th1 and Th2 cells), CD8+T cells (e.g. cytotoxic T cells), peripheral Including but not limited to blood mononuclear cells (PBMC), peripheral blood leukocytes (PBL), tumor infiltrating lymphocytes (TIL), memory T cells, naive T cells, regulatory T cells, γδ T cells, etc. It can be any T cell at any stage of development. Additional types of helper T cells include Th3 (Treg) cells, Th17 cells, Th9 cells, or Tfh cells. Additional types of memory T cells include cells such as central memory T cells (Tcm cells), effector memory T cells (Tem cells and TEMRA cells). A T cell can also refer to a genetically modified T cell, such as a T cell that has been modified to express a T cell receptor (TCR) or a chimeric antigen receptor (CAR). T cells can also be differentiated from stem cells or progenitor cells.

"CD4+T cells" refers to a subset of T cells that express CD4 on their surface and are associated with a cellular immune response. CD4+T cells are characterized by a post-stimulation secretion profile that can include secretion of cytokines such as IFN-γ, TNF-α, IL-2, IL-4 and IL-10. "CD4" is a 55 kD glycoprotein originally defined as a differentiation antigen on T lymphocytes, but was also found on other cells including monocytes/macrophages. The CD4 antigen is a member of the immunoglobulin superfamily and has been implicated as an associative recognition element in MHC (major histocompatibility complex) class II restricted immune responses. On T lymphocytes, the CD4 antigen defines a helper/inducer subset.

"CD8+T cells" refers to a subset of T cells that express CD8 on their surface, are MHC class I restricted, and function as cytotoxic T cells. The "CD8" molecule is a differentiation antigen present on thymocytes, as well as on cytotoxic and suppressor T lymphocytes. The CD8 antigen is a member of the immunoglobulin superfamily and is an associative recognition element in major histocompatibility complex class I restriction interactions.

As used herein, the term "ex vivo" generally includes experiments or measurements made in or on living tissue, preferably in an artificial environment outside the organism, preferably with minimal differences from natural conditions.

As used herein, the term "construct" refers to a complex of molecules, including macromolecules or polynucleotides.

As used herein, the term "integration" refers to the process of stably inserting one or more nucleotides of a construct into the cell genome, i.e., covalently linking to a nucleic acid sequence in the chromosomal DNA of the cell. It may also refer to nucleotide deletions at a site of integration. Where there is a deletion at the insertion site, "integration" may further include substitution of the endogenous sequence or nucleotide deleted with one or more inserted nucleotides.

As used herein, the term "exogenous" refers to a molecule or activity that has been introduced into a host cell and is not native to that cell. The molecule can be introduced, for example, by introduction of the encoding nucleic acid into host genetic material, such as by integration into a host chromosome, or as non-chromosomal genetic material, such as a plasmid. Thus, the term, when used in connection with expression of an encoding nucleic acid, refers to the introduction of the encoding nucleic acid into a cell in an expressible form. The term "endogenous" refers to a molecule or activity that is present in a host cell under natural, unedited conditions. Similarly, the term, when used in connection with expression of the encoding nucleic acid, refers to expression of the encoding nucleic acid that is contained within the cell and not introduced exogenously.

As used herein, a "polynucleotide donor construct" refers to a nucleotide sequence (e.g. DNA sequence) that is genetically inserted into a polynucleotide and is exogenous to that polynucleotide. The polynucleotide donor construct is transcribed into RNA and optionally translated into a polypeptide. The polynucleotide donor construct can include prokaryotic sequences, cDNA from eukaryotic mRNA, genomic DNA sequences from eukaryotic (e.g., mammalian) DNA, and synthetic DNA sequences. For example, the polynucleotide donor construct can be a miRNA, shRNA, natural polypeptide (i.e., a naturally occurring polypeptide) or fragment thereof or a variant polypeptide (e.g. a natural polypeptide having less than 100% sequence identity with the natural polypeptide) or fragments thereof.

As used herein, the term "transgene" refers to a polynucleotide that has been transferred naturally, or by any of a number of genetic engineering techniques from one organism to another. It is optionally translated into a polypeptide. It is optionally translated into a recombinant protein. A "recombinant protein" is a protein encoded by a gene recombinant DNA—that has been cloned in a system that supports expression of the gene and translation of messenger RNA (see expression system). The recombinant protein can be a therapeutic agent, e.g. a protein that treats a disease or disorder disclosed herein. As used, transgene can refer to a polynucleotide that encodes a polypeptide. A transgene can also refer to a non-encoding sequence, such as, but not limited to shRNAs, miRNAs, and miRs.

The terms "protein," "polypeptide," and "peptide" are used herein interchangeably.

As used herein, the term "operably linked" refers to the binding of a nucleic acid sequence to a single nucleic acid fragment such that one function is affected by the other. For example, if a promoter is capable of affecting the expression of a coding sequence or functional RNA (i.e., the coding sequence or functional RNA is under transcriptional control by the promoter), the promoter is operably linked thereto. Coding sequences can be operably linked to control sequences in both sense and antisense orientation.

As used herein, the term "developmental cell states" refers to, for example, states when the cell is inactive, actively expressing, differentiating, senescent, etc. developmental cell state may also refer to a cell in a precursor state (e.g., a T cell precursor).

As used, the term "encoding" refers to a sequence of nucleic acids which codes for a protein or polypeptide of interest. The nucleic acid sequence may be either a molecule of DNA or RNA. In preferred embodiments, the molecule is a DNA molecule. In other preferred embodiments, the molecule is a RNA molecule. When present as a RNA molecule, it will comprise sequences which direct the ribosomes of the host cell to start translation (e.g., a start codon, ATG) and direct the ribosomes to end translation (e.g., a stop codon). Between the start codon and stop codon is an open reading frame (ORF). Such terms are known to one of ordinary skill in the art.

The term "inserting" refers to a manipulation of a nucleotide sequence to introduce a non-native sequence. This is done, for example, via the use of restriction enzymes and ligases whereby the DNA sequence of interest, usually encoding the gene of interest, can be incorporated into another nucleic acid molecule by digesting both molecules with appropriate restriction enzymes in order to create compatible overlaps and then using a ligase to join the molecules together. One skilled in the art is very familiar with such manipulations and examples may be found in Sambrook et al. (Sambrook, Fritsch, & Maniatis, "Molecular Cloning: A Laboratory Manual", 2nd ed., Cold Spring Harbor Laboratory, 1989), which is hereby incorporated by reference in its entirety including any drawings, figures and tables.

As used herein, the term "subject" refers to a mammalian subject. Exemplary subjects include humans, monkeys, dogs, cats, mice, rats, cows, horses, camels, goats, rabbits, pigs and sheep. In certain embodiments, the subject is a human. In some embodiments the subject has a disease or condition that can be treated with an engineered cell provided herein or population thereof. In some aspects, the disease or condition is a cancer.

As used herein, the term "promoter" refers to a nucleotide sequence (e.g. DNA sequence) capable of controlling the expression of a coding sequence or functional RNA. The promoter sequence consists of proximal and more distal upstream elements, the latter elements often referred to as enhancers. A promoter can be derived from natural genes in its entirety, can be composed of different elements from different promoters found in nature, and/or may comprise synthetic DNA segments. A promoter, as contemplated herein, can be endogenous to the cell of interest or exogenous to the cell of interest. It is appreciated by those skilled in the art that different promoters can induce gene expression in different tissue or cell types, or at different developmental stages, or in response to different environmental conditions. As is known in the art, a promoter can be selected according to the strength of the promoter and/or the conditions under which the promoter is active, e.g., constitutive promoter, strong promoter, weak promoter, inducible/repressible promoter, tissue specific Or developmentally regulated promoters, cell cycle-dependent promoters, and the like.

A promoter can be an inducible promoter (e.g., a heat shock promoter, tetracycline-regulated promoter, steroid-regulated promoter, metal-regulated promoter, estrogen receptor-regulated promoter, etc.). The promoter can be a constitutive promoter (e.g., CMV promoter, UBC promoter). In some embodiments, the promoter can be a spatially restricted and/or temporally restricted promoter (e.g., a tissue specific promoter, a cell type specific promoter, etc.). See for example U.S. application Ser. No. 15/715,068, the disclosures of which are herein incorporated by reference in their entirety.

Gene editing, as contemplated herein, may involve a gene (or nucleotide sequence) knock-in or knock-out. As used herein, the term "knock-in" refers to an addition of a DNA sequence, or fragment thereof into a genome. Such DNA sequences to be knocked-in may include an entire gene or genes, may include regulatory sequences associated with a gene or any portion or fragment of the foregoing. For example, a polynucleotide donor construct encoding a recombinant protein may be inserted into the genome of a cell carrying a mutant gene. In some embodiments, a knock-in strategy involves substitution of an existing sequence with the provided sequence, e.g., substitution of a mutant allele with a wild-type copy. On the other hand, the term "knock-out" refers to the elimination of a gene or the expression of a gene. For example, a gene can be knocked out by either a deletion or an addition of a nucleotide sequence that leads to a disruption of the reading frame. As another example, a gene may be knocked out by replacing a part of the gene with an irrelevant (e.g., non-coding) sequence.

As used herein, the term "non-homologous end joining" or NHEJ refers to a cellular process in which cut or nicked ends of a DNA strand are directly ligated without the need for a homologous template nucleic acid. NHEJ can lead to the addition, the deletion, substitution, or a combination thereof, of one or more nucleotides at the repair site.

As used herein, the term "homology directed repair" or HDR refers to a cellular process in which cut or nicked ends of a DNA strand are repaired by polymerization from a homologous template nucleic acid. Thus, the original sequence is replaced with the sequence of the template. The homologous template nucleic acid can be provided by homologous sequences elsewhere in the genome (sister chromatids, homologous chromosomes, or repeated regions on the same or different chromosomes). Alternatively, an exogenous template nucleic acid can be introduced to obtain a specific HDR-induced change of the sequence at the target site. In this way, specific mutations can be introduced at the cut site.

The terms "vector" and "plasmid" are used interchangeably and as used herein refer to polynucleotide vehicles useful to introduce genetic material into a cell. Vectors can be linear or circular. Vectors can integrate into a target genome of a host cell or replicate independently in a host cell. Vectors can comprise, for example, an origin of replication, a multicloning site, and/or a selectable marker. An expression vector typically comprises an expression cassette. Vectors and plasmids include, but are not limited to, integrating vectors, prokaryotic plasmids, eukaryotic plasmids, plant synthetic chromosomes, episomes, viral vectors, cosmids, and artificial chromosomes.

As used herein the term "expression cassette" is a polynucleotide construct, generated recombinantly or synthetically, comprising regulatory sequences operably linked to a selected polynucleotide to facilitate expression of the selected polynucleotide in a host cell. For example, the regulatory sequences can facilitate transcription of the selected polynucleotide in a host cell, or transcription and translation of the selected polynucleotide in a host cell. An expression cassette can, for example, be integrated in the genome of a host cell or be present in an expression vector.

As used herein, the phrase "subject in need thereof" refers to a subject that exhibits and/or is diagnosed with one or more symptoms or signs of a disease or disorder as described herein.

A "chemotherapeutic agent" refers to a chemical compound useful in the treatment of cancer. Chemotherapeutic agents include "anti-hormonal agents" or "endocrine therapeutics" which act to regulate, reduce, block, or inhibit the effects of hormones that can promote the growth of cancer.

The term "composition" refers to a mixture that contains, e.g., an engineered cell or protein contemplated herein. In some embodiments, the composition may contain additional components, such as adjuvants, stabilizers, excipients, and the like. The term "composition" or "pharmaceutical composition" refers to a preparation which is in such form as to permit the biological activity of an active ingredient contained therein to be effective in treating a subject, and which contains no additional components which are unacceptably toxic to the subject in the amounts provided in the pharmaceutical composition.

As used herein, the term "effective amount" refers to the amount of a compound (e.g., a compositions described herein, cells described herein) sufficient to effect beneficial or desired results. An effective amount can be administered in one or more administrations, applications or dosages and is not intended to be limited to a particular formulation or administration route. As used herein, the term "treating" includes any effect, e.g., lessening, reducing, modulating, ameliorating or eliminating, that results in the improvement of the condition, disease, disorder, and the like, or ameliorating a symptom thereof.

The terms "modulate" and "modulation" refer to reducing or inhibiting or, alternatively, activating or increasing, a recited variable.

The terms "increase" and "activate" refer to an increase of 10%, 20%, 30%, 40%, 50%, 60%, 70%, 75%, 80%, 85%, 90%, 95%, 100%, 2-fold, 3-fold, 4-fold, 5-fold, 10-fold, 20-fold, 50-fold, 100-fold, or greater in a recited variable.

The terms "reduce" and "inhibit" refer to a decrease of 10%, 20%, 30%, 40%, 50%, 60%, 70%, 75%, 80%, 85%, 90%, 95%, 2-fold, 3-fold, 4-fold, 5-fold, 10-fold, 20-fold, 50-fold, 100-fold, or greater in a recited variable.

1. Safe Harbor Loci

Gene editing therapies include, for example, viral vector integration and site specific integration. Site-specific integration is a promising alternative to random integration of viral vectors, as it mitigates the risks of insertional mutagenesis or insertional oncogenesis (Kolb et al. Trends Biotechnol. 2005 23:399-406; Porteus et al. Nat Biotechnol. 2005 23:967-973; Paques et al. Curr Gen Ther. 2007 7:49-66). However, site specific integration continues to face challenges such as poor knock-in efficiency, risk of insertional oncogenesis, unstable and/or anomalous expression of adjacent genes or the transgene, low accessibility (e.g. within 20 kB of adjacent genes), etc. These challenges can be addressed, in part, through the identification and use of safe harbor loci or safe harbor sites (SHS), which are sites in which genes or genetic elements can be incorporated without disruption to expression or regulation of adjacent genes.

The most widely used of the putative human safe harbor sites is the AAVS1 site on chromosome 19q, which was initially identified as a site for recurrent adenoassociated virus insertion. Other potential SHS have been identified on the basis of homology, with sites first identified in other species (e.g., the human homolog of the permissive murine Rosa26 locus) or among the growing number of human genes that appear non-essential under some circumstances. One putative SHS of this type is the CCR5 chemokine receptor gene, which, when disrupted, confers resistance to human immunodeficiency virus infection. Additional potential genomic SHS have been identified in human and other cell types on the basis of viral integration site mapping or gene-trap analyses, as was the original murine Rosa26 locus. The three top SHS, AAVS1, CCR5, and Rosa26, are in close proximity to many protein coding genes and regulatory elements. (See FIG. 2 from Sadelain, M., et al. (2012). Safe harbours for the integration of new DNA in the human genome. Nature reviews Cancer, 12(1), 51-58, the relevant disclosures of which are herein incorporated by reference in their entirety).

The AAVS1 (also known as the PPP1R12C locus) on human chromosome 19 is a known SHS for hosting transgenes (e.g. DNA transgenes) with expected function. It is at position 19q13.42. It has an open chromatin structure and is transcription-competent. The canonical SHS locus for AAVS1 is chr19: 55,625,241-55,629,351. See Pellenz et al. "New Human Chromosomal Sites with "Safe Harbor" Potential for Targeted Transgene Insertion." Human gene therapy vol. 30, 7 (2019): 814-828, the relevant disclosures of which are herein incorporated by reference. An exemplary AAVS1 target gRNA and target sequence are provided below:

```
AAVS1-gRNA sequence:
                                    (SEQ ID NO: 121)
ggggccactagggacaggatGTTTTAGAGCTAGAAATAGCAAGTTAAAA

TAAGGCTAGTCCGTTATCAACTTGAAAAAGTGGCACCGAGTCGGTGCTT

TTTTT

AAVS1 target sequence:
                                    (SEQ ID NO: 122)
ggggccactagggacaggat
```

CCR5, which is located on chromosome 3 at position 3p21.31, encodes the major co-receptor for HIV-1. Disruption at this site in the CCR5 gene has been beneficial in HIV/AIDS therapy and prompted the development of zinc-finger nucleases that target its third exon. The canonical SHS locus for CCR5 is chr3: 46,414,443-46,414,942. See Pellenz et al. "New Human Chromosomal Sites with "Safe Harbor" Potential for Targeted Transgene Insertion." Human gene therapy vol. 30, 7 (2019): 814-828, the relevant disclosures of which are herein incorporated by reference.

The mouse Rosa26 locus is particularly useful for genetic modification as it can be targeted with high efficiency and is expressed in most cell types tested. Trion et al. 2007 ("Identification and targeting of the ROSA26 locus in human embryonic stem cells." Nature biotechnology 25.12 (2007): 1477-1482, the relevant disclosure of which are herein incorporated by reference) identified the human homolog, human ROSA26, in chromosome 3 (position 3p25.3). The canonical SHS locus for human Rosa26 (hRosa26) is chr3: 9,415,082-9,414,043. See Pellenz et al. "New Human Chromosomal Sites with "Safe Harbor" Potential for Targeted Transgene Insertion." Human gene therapy vol. 30, 7 (2019): 814-828, the relevant disclosures of which are herein incorporated by reference.

Additional examples of safe harbor sites are provided in Pellenz et al. "New Human Chromosomal Sites with "Safe Harbor" Potential for Targeted Transgene Insertion." Human gene therapy vol. 30, 7 (2019): 814-828, the relevant disclosures of which are herein incorporated by reference.

The present disclosure is directed to methods for identifying safe harbor loci with benefits including, but not limited to, high knock-in efficiency and high expression of transgene. An example of applications of the presently disclosed methods is the identification of safe harbor loci for insertion of transgenes (e.g., chimeric antigen receptors (CAR)) into T-cells. In some embodiments, the safe harbor loci of the present disclosure are useful for the insertion of a sequence encoding a transgene. In some embodiments, the safe harbor sites allow for high transgene expression (sufficient to allow for transgene functionality or treatment of a disease of interest) and stable expression of the transgene over several days, weeks or months. In some embodiments, knockout of the gene at the safe harbor locus confers benefit to the function of the cell, or the gene at the safe harbor locus has no known function within the cell. In some embodiments the safe harbor locus results in stable transgene expression in vitro with or without CD3/CD28 stimulation, negligible off-target cleavage as detected by iGuide-Seq or CRISPR-Seq, less off-target cleavage relative to other loci as detected by iGuide-Seq or CRISPR-Seq, negligible transgene-independent cytotoxicity, negligible transgene-independent cytokine expression, negligible transgene-independent chimeric antigen receptor expression, negligible deregulation or silencing of nearby genes, and positioned outside of a cancer-related gene.

As used, a "nearby gene" can refer to a gene that is within about 100 kB, about 125 kB, about 150 kB, about 175 kB, about 200 kB, about 225 kB, about 250 kB, about 275 kB, about 300 kB, about 325 kB, about 350 kB, about 375 kB, about 400 kB, about 425 kB, about 450 kB, about 475 kB, about 500 kB, about 525 kB, about 550 kB away from the safe harbor locus (integration site).

In some embodiments, the present disclosure contemplates inserts that comprise one or more transgenes. The transgene can encode a therapeutic protein, an antibody, a peptide, a suicide gene, an apoptosis gene or any other gene of interest. The safe harbor loci identified using the method described herein allow for transgene integration that results in, for example, enhanced therapeutic properties. These enhanced therapeutic properties, as used herein, refer to an enhanced therapeutic property of a cell when compared to a typical immune cell of the same normal cell type. For example, an NK cell having "enhanced therapeutic properties" has an enhanced, improved, and/or increased treatment outcome when compared to a typical, unmodified and/or naturally occurring NK cell. The therapeutic properties of immune cells can include, but are not limited to, cell transplantation, transport, homing, viability, self-renewal, persistence, immune response control and regulation, survival, and cytotoxicity. The therapeutic properties of immune cells are also manifested by: antigen-targeted receptor expression; HLA presentation or lack thereof; tolerance to the intratumoral microenvironment; induction of bystander immune cells and immune regulation; improved target specificity with reduction; resistance to treatments such as chemotherapy.

As used herein, the term "insert size" refers to the length of the nucleotide sequence being integrated (inserted) at the safe harbor site. In some embodiments, the insert size comprises at least about 100, 200, 300, 400 or 500 basepairs. In some embodiments, the insert size comprises about 500 nucleotides or basepairs. In some embodiments, the insert size comprises up to 0.5, 0.6, 0.7, 0.8, 0.9, 1, 2, 3, 4, 5, 6, 7, 8, 9, 10, 11, 12, 13, 14, 15, 16, 17, 18, 19, 20 kbp (kilo basepairs) or the sizes in between. In some embodiments, the insert size is greater than 0.5, 0.6, 0.7, 0.8, 0.9, 1, 2, 3, 4, 5, 6, 7, 8, 9, 10, 11, 12, 13, 14, 15, 16, 17, 18, 19, 20 kbp or the sizes in between. In some embodiments, the insert size is within the range of 3-15 kbp or is any number in that range. In some embodiments, the insert size is within the range of 1.5-8.3 kbp or is any number in that range. In some embodiments, the insert size is within the range of 1.5-15 kbp or is any number in that range. In some embodiments, the insert size is within the range of 0.5-20 kbp or is any number in that range. In some embodiments, the insert size is 0.5-10, 0.6-10, 0.7-10, 0.8-10, 0.9-10, 1-10, 2-10, 3-10, 4-10, 5-10, 6-10, 7-10, 8-10, 9-10 kbp. In some embodiments, the insert size is 0.5-11, 0.6-11, 0.7-11, 0.8-11, 0.9-11, 1-11, 2-11, 3-11, 4-11, 5-11, 6-11, 7-11, 8-11, 9-11, or 10-11 kbp. In some embodiments, the insert size is 0.5-12, 0.6-12, 0.7-12, 0.8-12, 0.9-12, 1-12, 2-12, 3-12, 4-12, 5-12, 6-12, 7-12, 8-12, 9-12, 10-12, or 11-12 kbp. In some embodiments, the insert size is 0.5-13, 0.6-13, 0.7-13, 0.8-13, 0.9-13, 1-13, 2-13, 3-13, 4-13, 5-13, 6-13, 7-13, 8-13, 9-13, 10-13, 11-13, or 12-13 kbp. In some embodiments, the insert size is 0.5-14, 0.6-14, 0.7-14, 0.8-14, 0.9-14, 1-14, 2-14, 3-14, 4-14, 5-14, 6-14, 7-14, 8-14, 9-14, 10-14, 11-14, 12-14 or 13-14 kbp. In some embodiments, the insert size is 0.5-15, 0.6-15, 0.7-15, 0.8-15, 0.9-15, 1-15, 2-15, 3-15, 4-15, 5-15, 6-15, 7-15, 8-15, 9-15, 10-15, 11-15, 12-15, 13-15, or 14-15 kbp. In some embodiments, the insert size is 0.5-16, 0.6-16, 0.7-16, 0.8-16, 0.9-16, 1-16, 2-16, 3-16, 4-16, 5-16, 6-16, 7-16, 8-16, 9-16, 10-16, 11-16, 12-16, 13-16, 14-16 or 15-16 kbp. In some embodiments, the insert size is 0.5-17, 0.6-17, 0.7-17, 0.8-17, 0.9-17, 1-17, 2-17, 3-17, 4-17, 5-17, 6-17, 7-17, 8-17, 9-17, 10-17, 11-17, 12-17, 13-17, or 14-17, 15-17 or 16-17 kbp. In some embodiments, the insert size is 0.5-18, 0.6-18, 0.7-18, 0.8-18, 0.9-18, 1-18, 2-18, 3-18, 4-18, 5-18, 6-18, 7-18, 8-18, 9-18, 10-18, 11-18, 12-18, 13-18, 14-18, 15-18, 16-18 or 17-18 kbp. In some embodiments, the insert size is 0.5-19, 0.6-19, 0.7-19, 0.8-19, 0.9-19, 1-19, 2-19, 3-19, 4-19, 5-19, 6-19, 7-19, 8-19, 9-19, 10-19, 11-19, 12-19, 13-19, 14-19, 15-19, 16-19, 17-19, or 18-19 kbp. In some embodiments, the insert size is 0.5-20, 0.6-20, 0.7-20, 0.8-20, 0.9-20, 1-20, 2-20, 3-20, 4-20, 5-20, 6-20, 7-20, 8-20, 9-20, 10-20, 11-20, 12-20, 13-20, 14-20, 15-20, 16-20, 17-20, 18-20, or 19-20 kbp.

The inserts of the present disclosure refer to nucleic acid molecules or polynucleotide inserted at a safe harbor site. In some embodiments, the nucleotide sequence is a DNA molecule, e.g., genomic DNA, or comprises deoxy-ribonucleotides. In some embodiments, the insert comprises a smaller fragment of DNA, such as a plastid DNA, mitochondrial DNA, or DNA isolated in the form of a plasmid, a fosmid, a cosmid, a bacterial artificial chromosome (BAC), a yeast artificial chromosome (YAC), and/or any other sub-genome segment of DNA. In some embodiments, the insert is an RNA molecule or comprises ribonucleotides. The nucleotides in the insert are contemplated as naturally occuring nucleotides, non-naturally occuring, and modified nucleotides. Nucleotides may be modified chemically or biochemically, or may contain non-natural or derivatized nucleotide bases, as will be readily appreciated by those of skill in the art. Such modifications include, for example, labels, methylation, substitution of one or more of the naturally occurring nucleotides with an analog, internucleotide modifications. The polynucleotides can be in any topological conformation, including single-stranded, double-stranded, partially duplexed, triplexed, hairpinned, circular conformations, and other three-dimension conformations contemplated in the art.

The inserts can have coding and/or non-coding regions. The insert can comprises a non-coding sequence (e.g., control elements, e.g., a promoter sequence). In some embodiments, the insert encodes transcription factors. In some embodiments, the insert encodes an antigen binding receptors such as single receptors, T-cell receptors (TCRs), syn-notch, CARs, mAbs, etc. In some embodiments, the inserts are RNAi molecules, including, but not limited to, miRNAs, siRNA, shRNAs, etc. In some embodiments, the the insert is a human sequence. In some embodiments, the insert is chimeric. In some embodiments, the insert is a multi-gene/multi-module therapeutic cassette. A multi-gene/multi-module therapeutic cassette referst to an insert or cassette having one or more than one receptor (e.g., synthetic receptors), other exogenous protein coding sequences, non-coding RNAs, transcriptional regulatory elements, and/ or insulator sequences, etc.

Various cell types are contemplated as having the safe harbor sites in the present disclosure. A cell comprising a safe harbor site and/or a cell comprising an insert at a safe harbor site as described in the present disclosure can be referred to as an engineered cell. The cells can include, but are not limited to, eukaryotic cells, prokaryotic cells, animal cells, plant cells, fungal cells and the like. Optionally, the cell is a mammalian cell, for example, a human cell. In some embodiments, that engineered cell is a stem cell, a human cell, a primary cell, an hematopoietic cell, an adaptive immune cell, an innate immune cell, a T cell or a T cell progenitor. Non-limiting examples of immune cells that are contemplated in the present disclosure include T cell, B cell, natural killer (NK) cell, NKT/iNKT cell, macrophage, myeloid cell, and dendritic cells. Non-limiting examples of stem cells that are contemplated in the present disclosure include pluripotent stem cells (PSCs), embryonic stem cells (ESCs), induced pluripotent stem cells (iPSCs), embryo-derived embryonic stem cells obtained by nuclear transfer (ntES; nuclear transfer ES), male germline stem cells (GS cells), embryonic germ cells (EG cells), hematopoietic stem/ progenitor stem cells (HSPCs), somatic stem cells (adult stem cells), hemangioblasts, neural stem cells, mesenchymal stem cells and stem cells of other cells (including osteocyte, chondrocyte, myocyte, cardiac myocyte, neuron, tendon cell, adipocyte, pancreocyte, hepatocyte, nephrocyte and follicle cells and so on). In some embodiments, the engineered cells is a T cell, NK cells, iPSC, and HSPC. In some embodiments, the engineered cells used in the present disclosure are human cell lines grown in vitro (e.g. deliberately immortalized cell lines, cancer cell lines, etc.).

The methods for integrating the inserts at the safe harbor sites can be viral or non-viral delivery techniques.

In some embodiments, the nucleic acid sequence is inserted into the genome of the engineered cell by introducing a vector, for example, a viral vector, comprising the nucleic acid. Examples of viral vectors include, but are not limited to, adeno-associated viral (AAV) vectors, retroviral vectors or lentiviral vectors. In some embodiments, the lentiviral vector is an integrase-deficient lentiviral vector.

In some embodiments, the nucleic acid sequence is inserted into the genome of the T cell via non-viral delivery. In non-viral delivery methods, the nucleic acid can be naked DNA, or in a non-viral plasmid or vector. Non-viral delivery techniques can be site-specific integration techniques, as described herein or known to those of ordinary skill in the art. Examples of site-specific techniques for integration into the safe harbor loci include, without limitation, homology-dependent engineering using nucleases and homology independent targeted insertion using Cas9.

In some embodiments, the insert is integrated at a safe harbor site by introducing into the engineered cell, (a) a targeted nuclease that cleaves a target region in the safe harbor site to create the insertion site; and (b) the nucleic acid sequence (insert), wherein the insert is incorporated at the insertion site by, e.g., HDR. Examples of non-viral delivery techniques that can be used in the methods of the present disclosure are provided in U.S. application Ser. Nos. 16/568,116 and 16/622,843, the relevant disclosures of which are herein incorporated by reference in their entirety.

2. CAR T Cell Therapy

Chimeric antigen receptor (CAR) T cells are T cells that have been genetically engineered to produce an artificial T-cell receptor for use in immunotherapy. Chimeric antigen receptors are receptor proteins that have been engineered to confer T cells with the ability to target a specific protein. The genetic modification of lymphocytes (e.g. T cells) by incorporation of, for example, CARs, and administration of the engineered cells to a subject is an example of "adoptive cell therapy". As used herein, the term "adoptive cell therapy" refers to cell-based immunotherapy for transfusion of autologous or allogeneic lymphocytes, referred to as T cells or B cells. In this CAR therapy approach, cells are expanded and cultured ex vivo and genetically modified, prior to transfusion.

The expression of CARs allows the engineered T-cells to target and bind specific proteins, for example, tumor antigens. In CAR therapy, T-cells are harvested from a subject— they can be autologous T-cells from the subject own blood or from a donor that will not be receiving the CAR therapy. Once isolated, the T-cells are genetically modified with a CAR, expanded ex vivo, and administered to the subject (i.e. patient) by, e.g. infusion.

The CARs may be introduced into the T-cells using, for example, a viral technique (e.g., retroviral integration) or site-specific technique. With site specific integration of the transgenes (e.g. CARs), the transgenes may be targeted to a safe harbor locus. Examples of site-specific techniques for integration into the safe harbor loci include, without limitation, homology-dependent engineering using nucleases and homology independent targeted insertion using Cas9.

The engineered CAR T cells have applications to immune-oncology. The CAR, for example, can be selected to target a specific tumor antigen. Examples of cancers that can be effectively targeted using CAR T cells are blood cancers. In some embodiments, CAR T cell therapy can be used to treat solid tumors.

3. Gene Editing

The terms "gene editing" or "genome editing", as used herein, refer to a type of genetic manipulation in which DNA is inserted, replaced, or removed from the genome using artificially manipulated nucleases or "molecular scissors". It is a useful tool for elucidating the function and effect of sequence-specific genes or proteins or altering cell behavior (e.g. for therapeutic purposes).

Currently available genome editing tools include zinc finger nucleases (ZFN) and transcription activator-like effector nucleases (TALENs) to incorporate genes at safe harbor loci (e.g. the adeno-associated virus integration site 1 (AAVS1) safe harbor locus). The DICE (dual integrase cassette exchange) system utilizing phiC31 integrase and Bxb1 integrase is a tool for target integration. Additionally, clustered regularly interspaced short palindromic repeat/Cas9 (CRISPR/Cas9) techniques can be used for targeted gene insertion.

Site specific gene editing approaches can include homology dependent mechanisms or homology independent mechanisms.

All methods known in the art for targeted insertion of gene sequences are contemplated in the methods described herein to insert constructs at safe harbor loci.

4. Crispr-Cas Gene Editing

One effective example of gene editing is the Crisp-Cas approach (e.g. Crispr-Cas9). This approach incorporates the use of a guide polynucleotide (e.g. guide ribonucleic acid or gRNA) and a cas endonuclease (e.g. Cas9 endonuclease).

As used herein, a polypeptide referred to as a "Cas endonuclease" or having "Cas endonuclease activity" refers to a CRISPR-related (Cas) polypeptide encoded by a Cas gene, wherein a Cas polypeptide is a target DNA sequence that can be cleaved when operably linked to one or more guide polynucleotides (see, e.g., U.S. Pat. No. 8,697,359). Also included in this definition are variants of Cas endonuclease that retain guide polynucleotide-dependent endonuclease activity. The Cas endonuclease used in the donor DNA insertion method detailed herein is an endonuclease that introduces double-strand breaks into DNA at the target site (e.g., within the target locus or at the safe harbor site).

As used herein, the term "guide polynucleotide" relates to a polynucleotide sequence capable of complexing with a Cas endonuclease and allowing the Cas endonuclease to recognize and cleave a DNA target site. The guide polynucleotide can be a single molecule or a double molecule. The guide polynucleotide sequence can be an RNA sequence, a DNA sequence, or a combination thereof (RNA-DNA combination sequence). A guide polynucleotide comprising only ribonucleic acid is also referred to as "guide RNA". In some embodiments, a polynucleotide donor construct is inserted at a safe harbor locus using a guide RNA (gRNA) in combination with a cas endonuclease (e.g. Cas9 endonuclease).

The guide polynucleotide includes a first nucleotide sequence domain (also referred to as a variable targeting domain or VT domain) that is complementary to a nucleotide sequence in the target DNA, and a second nucleotide that interacts with a Cas endonuclease polypeptide. It can be a double molecule (also referred to as a double-stranded guide polynucleotide) comprising a sequence domain (referred to as a Cas endonuclease recognition domain or CER domain). The CER domain of this double molecule guide polynucleotide comprises two separate molecules that hybridize along the complementary region. The two separate molecules can be RNA sequences, DNA sequences and/or RNA-DNA combination sequences.

Genome editing using CRISPR-Cas approaches relies on the repair of site-specific DNA double-strand breaks (DSBs) induced by the RNA-guided Cas endonuclease (e.g. Cas 9 endonuclease). Homology-directed repair (HDR) of these DSBs enables precise editing of the genome by introducing defined genomic changes, including base substitutions, sequence insertions, and deletions. Conventional HDR-based CRISPR/Cas9 genome-editing involves transfecting cells with Cas9, gRNA and donor DNA containing homologous arms matching the genomic locus of interest.

HITI (homology independent targeted insertion) uses a non-homologous end joining (NHEJ)-based homology-independent strategy and the method can be more efficient than HDR. Guide RNAs (gRNAs) target the insertion site. For HITI, donor plasmids lack homology arms and DSB repair does not occur through the HDR pathway. The donor polynucleotide construct can be engineered to include Cas9 cleavage site(s) flanking the gene or sequence to be inserted. This results in Cas9 cleavage at both the donor plasmid and the genomic target sequence. Both target and donor have blunt ends and the linearized donor DNA plasmid is used by the NHEJ pathway resulting integration into the genomic DSB site. (See, for example, Suzuki, K., et al. (2016). In vivo genome editing via CRISPR/Cas9 mediated homology-independent targeted integration. Nature, 540(7631), 144-149, the relevant disclosures of which are herein incorporated in their entirety).

Methods for conducing gene editing using CRISPR-Cas approaches are known to those of ordinary skill in the art. (See, for example, U.S. application Ser. Nos. 16/312,676, 15/303,722, and 15/628,533, the disclosures of which are herein incorporated by reference in their entirety). Additionally, uses of endonucleases for inserting transgenes into safe harbor loci are described, for example, in U.S. application Ser. No. 13/036,343, the disclosures of which are herein incorporated by reference in their entirety.

The guide RNAs and/or mRNA (or DNA) encoding an endonuclease can be chemically linked to one or more moieties or conjugates that enhance the activity, cellular distribution, or cellular uptake of the oligonucleotide. Non-limiting examples of such moieties include lipid moieties such as a cholesterol moiety, cholic acid, a thioether, a thiocholesterol, an aliphatic chain (e.g., dodecandiol or undecyl residues), a phospholipid, e.g., di-hexadecyl-rac-glycerol or triethylammonium 1,2-di-O-hexadecyl-rac-glycero-3-H-phosphonate, a polyamine or a polyethylene glycol chain, adamantane acetic acid, a palmityl moiety and an octadecylamine or hexylamino-carbonyl-t oxycholesterol moiety. See for example U.S. application Ser. No. 15/715,068, the disclosures of which are herein incorporated by reference in their entirety.

5. Therapeutic Applications

For therapeutic applications, the engineered cells, populations thereof, or compositions thereof are administered to a subject, generally a mammal, generally a human, in an effective amount.

The engineered cells may be administered to a subject by infusion (e.g., continuous infusion over a period of time) or other modes of administration known to those of ordinary skill in the art.

The engineered cells provided herein can be administered as part of a pharmaceutical compositions. In some embodiments, the present disclosure provides compositions comprising a guide RNA of the present disclosure. The pharmaceutical composition may comprise one or more pharmaceutical excipients. Any suitable pharmaceutical excipient may be used, and one of ordinary skill in the art is capable of selecting suitable pharmaceutical excipients. Accordingly, the pharmaceutical excipients provided below are intended to be illustrative, and not limiting. Additional pharmaceutical excipients include, for example, those described in the *Handbook of Pharmaceutical Excipients*, Rowe et al. (Eds.) 6th Ed. (2009), incorporated by reference in its entirety.

The engineered cells provided herein not only find use in gene therapy but also in non-pharmaceutical uses such as, e.g., production of animal models and production of recombinant cell lines expressing a protein of interest.

The engineered cells of the present disclosure can be any cell, generally a mammalian cell, generally a human cell that has been modified by integrating a transgene at a safe harbor locus described herein. In some embodiments, the engineered cells are immune cells. In some embodiments, the engineered cells are lymphocytes. In some embodiments, the engineered cells are T cells or T cell precursors.

The engineered cells, compositions and methods of the present disclosure are useful for therapeutic applications such as CAR T cell therapy and TCR T cell therapy. In some embodiments, the insertion of a sequence encoding a transgene within a safe harbor locus maintains the TCR expression relative to instances when there is no insertion and enables transgene expression while maintaining TCR function.

Various diseases treated using the engineered cells, populations thereof, or compositions thereof are provided herein. Non-limiting examples of such diseases include alopecia areata, autoimmune hemolytic anemia, autoimmune hepatitis, cancer, dermatomyositis, diabetes (type 1), certain juvenile idiopathic arthritis, glomerulonephritis, Graves' disease, Guillain Valley Syndrome, idiopathic thrombocytopenic purpura, myasthenia gravis, certain myocarditis, multiple sclerosis, pemphigus/pemphigoid, pernicious anemia, polyarteritis *nodosa*, polymyositis, primary bile With cirrhosis, psoriasis, rheumatoid arthritis, scleroderma/systemic sclerosis, Sjogren's syndrome, systemic lupus erythematosus, certain thyroiditis, certain uveitis, vitiligo, multiple vasculitis (Wegener)); autoimmune disorders including, but not limited to, granulomatosis; hematopoietic tumors including but not limited to acute and chronic leukemia, lymphoma, multiple myeloma and myelodysplastic syndrome; tumors of the prostate, breast, lung, colon, uterus, skin, liver, bone, pancreas, ovary, testis, bladder, kidney, head, neck, stomach, cervix, rectum, larynx, or esophagus solid tumors; HIV (human immunodeficiency virus) related disorders, RSV (respiratory syncytial virus) related disorders; EBV (Epstein-Barr virus) related disorders; CMV (cytomegalovirus) related disorders; and infectious diseases including, but not limited to, adenovirus-related disorders and BK polyomavirus-related disorders.

Cancers that can be treated with the engineered cells (e.g., CAR T-cells) of the present disclosure, populations thereof, or compositions thereof include blood cancers. In some embodiments, the cancer treated using the engineered cells (e.g., CAR T-cells) described herein, populations thereof, or compositions thereof is a hematologic malignancy or leukemia. In some embodiments, the engineered cells (e.g., CAR T-cells) described herein, populations thereof, or compositions thereof are used for the treatment of acute lymphoblastic leukemia (ALL) or diffuse large B-cell lymphoma (DLBCL). In some embodiments, the cancer is acute myeloid leukemia (AML), acute lymphoblastic leukemia (ALL), myelodysplasia, myelodysplastic syndromes, acute T-lymphoblastic leukemia, or acute promyelocytic leukemia, chronic myelomonocytic leukemia, or myeloid blast crisis of chronic myeloid leukemia. Examples of cancers treatable using the engineered cells (e.g., CAR T-cells) described herein include, without limitation, breast cancer, ovarian cancer, esophageal cancer, bladder or gastric cancer, salivary duct carcinoma, salivary duct carcinomas, adenocarcinoma of the lung or aggressive forms of uterine cancer, such as uterine serous endometrial carcinoma. In some other embodiments, the cancer is brain cancer, breast cancer, cervical cancer, colon cancer, colorectal cancer, endometrial cancer, esophageal cancer, leukemia, lung cancer, liver cancer, melanoma, ovarian cancer, pancreatic cancer, rectal cancer, renal cancer, stomach cancer, testicular cancer, or uterine cancer. In yet other embodiments, the cancer is a squamous cell carcinoma, adenocarcinoma, small cell carcinoma, melanoma, neuroblastoma, sarcoma (e.g., an angiosarcoma or chondrosarcoma), larynx cancer, parotid cancer, biliary tract cancer, thyroid cancer, acral lentiginous melanoma, actinic keratoses, acute lymphocytic leukemia, acute myeloid leukemia, adenoid cystic carcinoma, adenomas, adenosarcoma, adenosquamous carcinoma, anal canal cancer, anal cancer, anorectum cancer, astrocytic tumor, bartholin gland carcinoma, basal cell carcinoma, biliary cancer, bone cancer, bone marrow cancer, bronchial cancer, bronchial gland carcinoma, carcinoid, cholangiocarcinoma, chondrosarcoma, choroid plexus papilloma/carcinoma, chronic lymphocytic leukemia, chronic myeloid leukemia, clear cell carcinoma, connective tissue cancer, cystadenoma, digestive system cancer, duodenum cancer, endocrine system cancer, endodermal sinus tumor, endometrial hyperplasia, endometrial stromal sarcoma, endometrioid adenocarcinoma, endothelial cell cancer, ependymal cancer, epithelial cell cancer, Ewing's sarcoma, eye and orbit cancer, female genital cancer, focal nodular hyperplasia, gallbladder cancer, gastric antrum cancer, gastric fundus cancer, gastrinoma, glioblastoma, glucagonoma, heart cancer, hemangioblastomas, hemangioendothelioma, hemangiomas, hepatic adenoma, hepatic adenomatosis, hepatobiliary cancer, hepatocellular carcinoma, Hodgkin's disease, ileum cancer, insulinoma, intraepithelial neoplasia, interepithelial squamous cell neoplasia, intrahepatic bile duct cancer, invasive squamous cell carcinoma, jejunum cancer, joint cancer, Kaposi's sarcoma, pelvic cancer, large cell carcinoma, large intestine cancer, leiomyosarcoma, lentigo maligna melanomas, lymphoma, male genital cancer, malignant melanoma, malignant mesothelial tumors, medulloblastoma, medulloepithelioma, meningeal cancer, mesothelial cancer, metastatic carcinoma, mouth cancer, mucoepidermoid carcinoma, multiple myeloma, muscle cancer, nasal tract cancer, nervous system cancer, neuroepithelial adenocarcinoma nodular melanoma, non-epithelial skin cancer, non-Hodgkin's lymphoma, oat cell carcinoma, oligodendroglial cancer, oral cavity cancer, osteosarcoma, papillary serous adenocarcinoma, penile cancer, pharynx cancer, pituitary tumors, plasmacytoma, pseudosarcoma, pulmonary blastoma, rectal cancer, renal cell carcinoma, respiratory system cancer, retinoblastoma, rhabdomyosarcoma, sarcoma, serous carcinoma, sinus cancer, skin cancer, small cell carcinoma, small intestine cancer, smooth muscle cancer, soft tissue cancer, somatostatin-secreting tumor, spine cancer, squamous cell carcinoma, striated muscle cancer, submesothelial cancer, superficial spreading melanoma, T cell leukemia, tongue cancer, undifferentiated carcinoma, ureter cancer, urethra cancer, urinary bladder cancer, urinary system cancer, uterine cervix cancer, uterine corpus cancer, uveal melanoma, vaginal cancer, verrucous carcinoma, VIPoma, vulva cancer, well-differentiated carcinoma, or Wilms tumor.

In some embodiments, the present disclosure provides methods of treating a subject in need of treatment by administering to the subject a composition comprising any of the engineered cells described herein. As used, the terms "treat," "treatment," and the like refer generally to obtaining a desired pharmacological and/or physiological effect. That effect is preventive in terms of complete or partial prevention of the disease and/or therapeutic in terms of partial or complete cure of the disease and/or adverse effects resulting from the disease. The term "treatment", as used herein, encompasses any treatment of a disease in a subject (e.g., mammal, e.g., human). Treatment may also refer to the administration of the engineered cells provided herein to a subject that is susceptible to the disease but has not yet been diagnosed as suffering from it, including preventing the disease from occurring; inhibiting disease progression; or reducing the disease (i.e., causing a regression of the disease). Further, treatment may stabilize or reduce undesirable clinical symptoms in subjects (e.g., patients). The cells provided herein populations thereof, or compositions thereof may be administered before, during or after the occurrence of the disease or injury.

In certain embodiments, the subject has a disease, condition, and/or injury that can be treated and/or ameliorated by cell therapy. In some embodiments, the subject in need of cell therapy is a subject having an injury, disease, or condition, thereby causing cell therapy (e.g., therapy in which cellular material is administered to the subject). However, it is contemplated that it is possible to treat, ameliorate and/or reduce the severity of at least one symptom associated with the injury, disease or condition. In certain embodiments, a subject in need of cell therapy includes, but is not limited to, a bone marrow transplant or stem cell transplant candidate, a subject who has received chemotherapy or radiation therapy, a hyperproliferative disease or cancer (e.g., a hematopoietic system), a subject having or at risk of developing a hyperproliferative disease or cancer), a subject having or at risk of developing a tumor (e.g., solid tumor), viral infection or virus. It is also intended to encompass subjects suffering from or at risk of suffering from a disease associated with an infection.

In some embodiments, the present disclosure provides a composition of the present disclosure along with instructions for use. The instructions for use can be present in the kits as a package insert, in the labeling of the container of the kit or components thereof, or can be in digital form (e.g. on a CD-ROM, via a link on the internet). A kit can include one or more of a genome-targeting nucleic acid, a polynucleotide encoding a genome-targeting nucleic acid, a site-directed polypeptide, and/or a polynucleotide encoding a site-directed polypeptide. Additional components within the kits are also contemplated, for example, buffer (such as reconstituting buffer, stabilizing buffer, diluting buffer), and/or one or more control vectors.

6. Combination Therapies

In some embodiments, an engineered cells of the present disclosure or composition thereof is administered with at least one additional therapeutic agent. Any suitable additional therapeutic agent may be administered with an engineered cell provided herein, populations thereof, or compositions thereof. In some aspects, the additional therapeutic agent is selected from radiation, an ophthalmologic agent, a cytotoxic agent, a chemotherapeutic agent, a cytostatic agent, an anti-hormonal agent, an immunostimulatory agent, an anti-angiogenic agent, and combinations thereof.

In some embodiments, an engineered cell of the present disclosure or composition thereof is administered with a steroid. The administration of a steroid can prevent or mitigate the risk of a subject receiving the engineered cell(s) or composition thereof having an autoimmune reaction.

The additional therapeutic agent may be administered by any suitable means. In some embodiments, the engineered cells described herein, populations thereof, or compositions thereof and the additional therapeutic agent is administered in the same pharmaceutical composition, e.g. by infusion. In some embodiments, the engineered cells described herein and additional therapeutic agent are included in different pharmaceutical compositions.

The pharmaceutical composition may comprise one or more pharmaceutical excipients. Any suitable pharmaceutical excipient may be used, and one of ordinary skill in the art is capable of selecting suitable pharmaceutical excipients. Accordingly, the pharmaceutical excipients provided below are intended to be illustrative, and not limiting. Additional pharmaceutical excipients include, for example, those described in the *Handbook of Pharmaceutical Excipients*, Rowe et al. (Eds.) 6th Ed. (2009), incorporated by reference in its entirety.

Various modes of administering the additional therapeutic agents are contemplated herein. In some embodiments, the additional therapeutic agent is administered by any suitable mode of administration. Generally, modes of administration include, without limitation, intravitreal, subretinal, suprachoroidal, intraarterial, intradermal, intramuscular, intraperitoneal, intravenous, nasal, parenteral, topical, pulmonary, and subcutaneous routes.

In embodiments where the engineered cells provided herein and the additional therapeutic agent are included in different pharmaceutical compositions, administration of the engineered cells provided herein can occur prior to, simultaneously, and/or following, administration of the additional therapeutic agent.

EXAMPLES

The following are examples of methods and compositions of the invention. It is understood that various other embodiments may be practiced, given the general description provided herein.

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W.H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); Methods In Enzymology (S. Colowick and N. Kaplan eds., Academic Press, Inc.); *Remington's Pharmaceutical Sciences*, 18th Edition (Easton, Pa.: Mack Publishing Company, 1990).

Example 1: Identification of Knock-In Loci in Coding Regions

The objective of the experiments in this set of examples was to identify T-cell knock-in (KI) loci in coding regions outside of the T Cell Receptor Alpha Constant (TRAC) locus. To select candidate loci, the criteria and requirements shown in Table 1 were used.

TABLE 1

Criteria used for identification of candidate knock-in loci within coding regions

| Criteria | Detailed Requirements | Datasets Considered for identification of loci |
|---|---|---|
| KI efficiency | High expression at d2 (day 2) Similar expression dynamics as TRAC (stable expression upon activation) Accessible chromatin gRNA editing efficiency | Knock in efficiency data on ~90 genes derived from Roth, T. L., et al. 2019. (Rapid discovery of synthetic DNA sequences to rewrite endogenous T cell circuits. bioRxiv, 604561.) Bulk RNA-seq data at d0, d2, d3 and d4: (i) publicly available data; (ii) data derived from Roth, T. L., et al. 2019. (Rapid discovery of synthetic DNA sequences to rewrite endogenous T cell circuits. bioRxiv, 604561.); and (iii) internally generated data Bulk ATAC-seq data at d0, d2, d3 and d4: (i) data derived from Roth, T. L., et al. 2019. (Rapid discovery of synthetic DNA sequences to rewrite endogenous T cell circuits. bioRxiv, 604561.); and (ii) internally generated data |
| Safety | Does not affect proliferation, cytolytic activity or signaling of T cells Be careful with tumor suppressors and oncogenes | T cell screening data Achilles' project on cancer cell lines data Annotated oncogenes and tumor suppressors from TCGA Annotated functions in immune cells |

Generally, the requirements for candidate KI loci within the coding regions was that the coding gene is not essential for T cell function or the knock-out of that gene would be beneficial to chimeric antigen receptor therapy (CAR T) functions.

Figure 3:
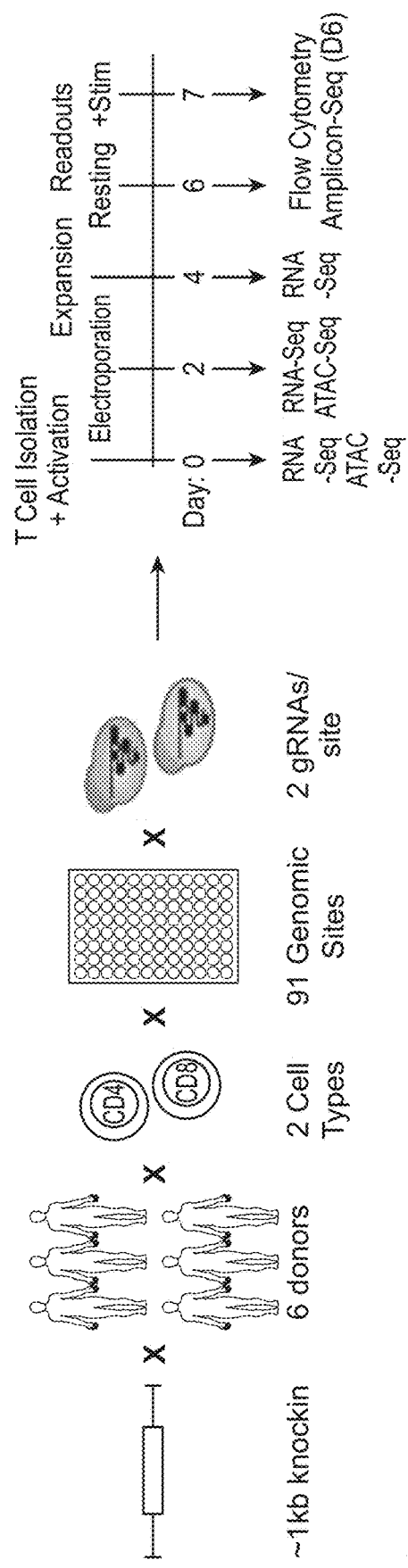
FIG. 3 includes a schematic outlining the data provided in Roth, T. L., et al. 2019. Rapid discovery of synthetic DNA sequences to rewrite endogenous T cell circuits. bioRxiv, 604561, the relevant disclosures of which are herein incorporated by reference in their entirety.

As shown in Table 1, some of the data utilized, for comparison purposes, to identify candidate KI loci was sourced, in part, from Roth, T. L., et al. 2019 (Rapid discovery of synthetic DNA sequences to rewrite endogenous T cell circuits. bioRxiv, 604561), the relevant disclosures of which are herein incorporated by reference in their entirety. A summary of data in the Roth, T. L. et al. paper is shown in FIG. 3.

Figure 4A:
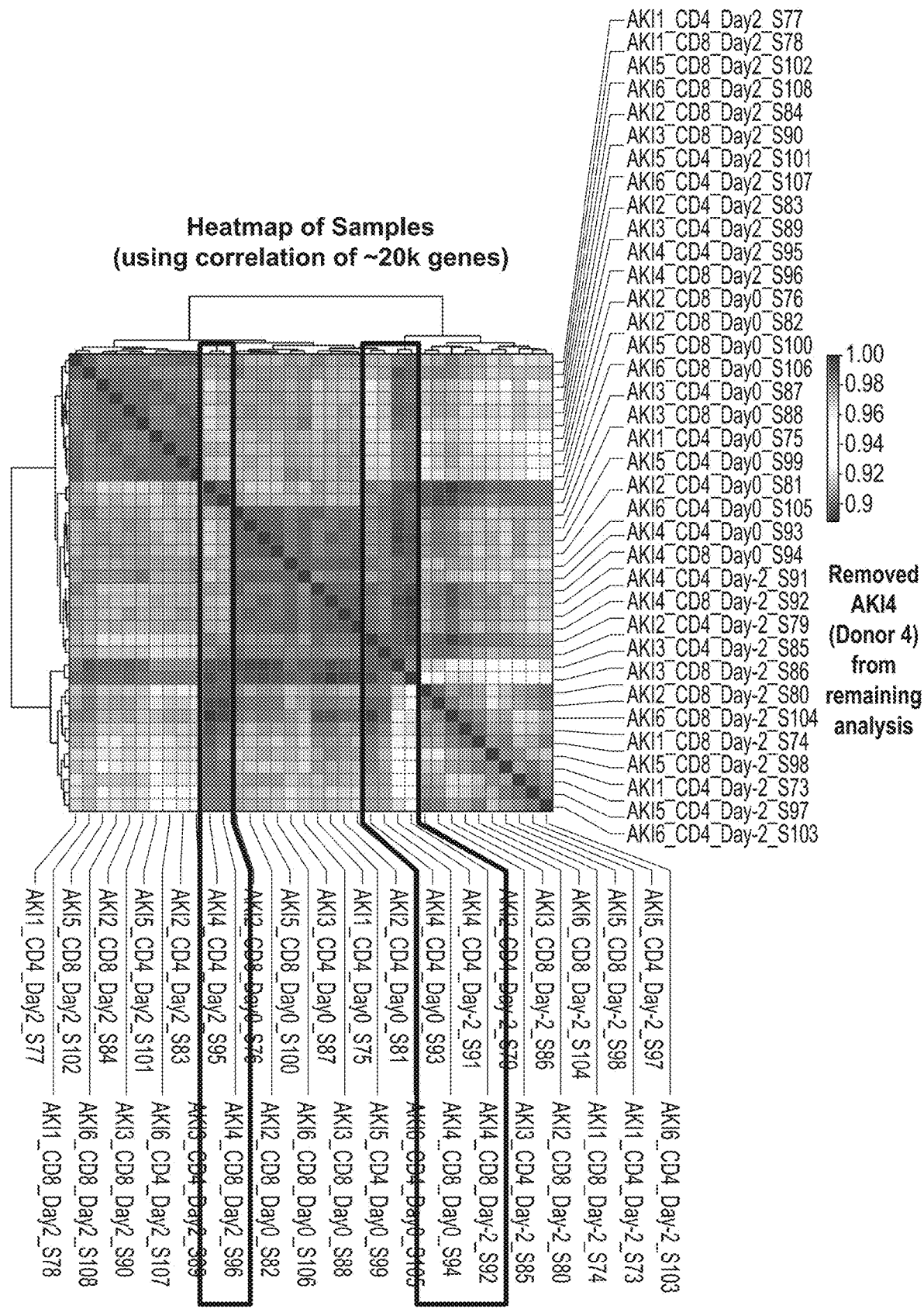
FIGS. 4A-4B include heatmaps with samples clustered based on activation status and cell type, generated with processed RNA-seq data.
Figure 4B:
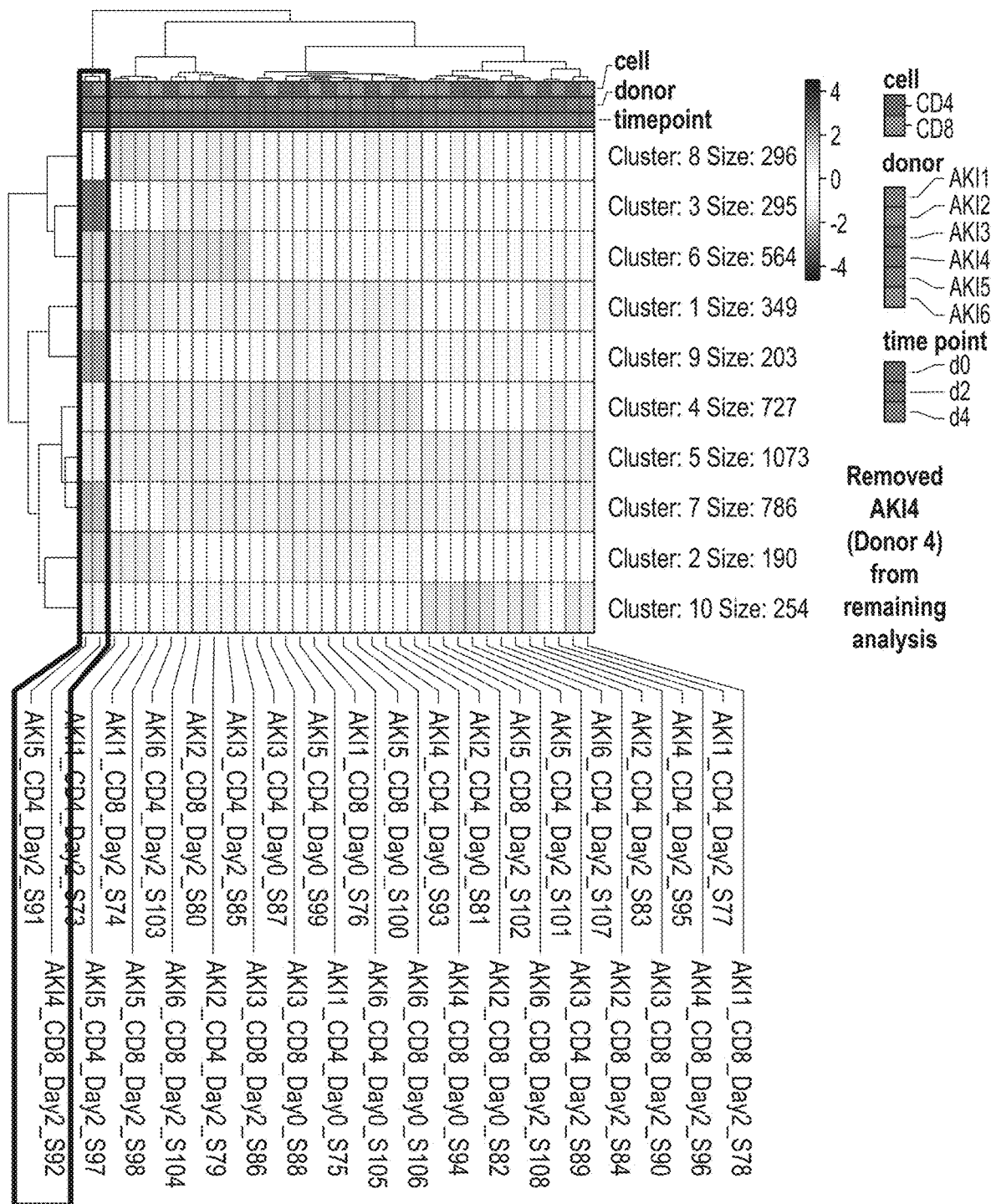
Figure 5A:
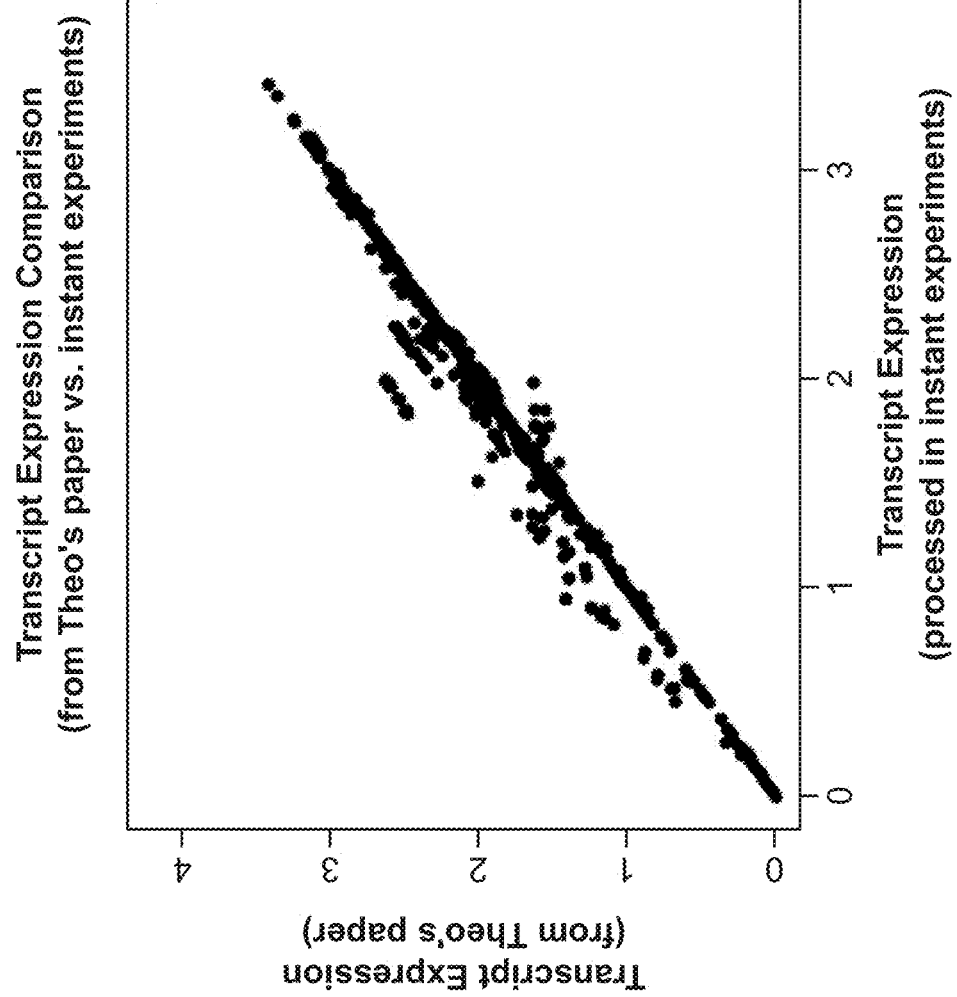
FIGS. 5A-5B include plots generated using processed RNA-seq data.
Figure 5B:
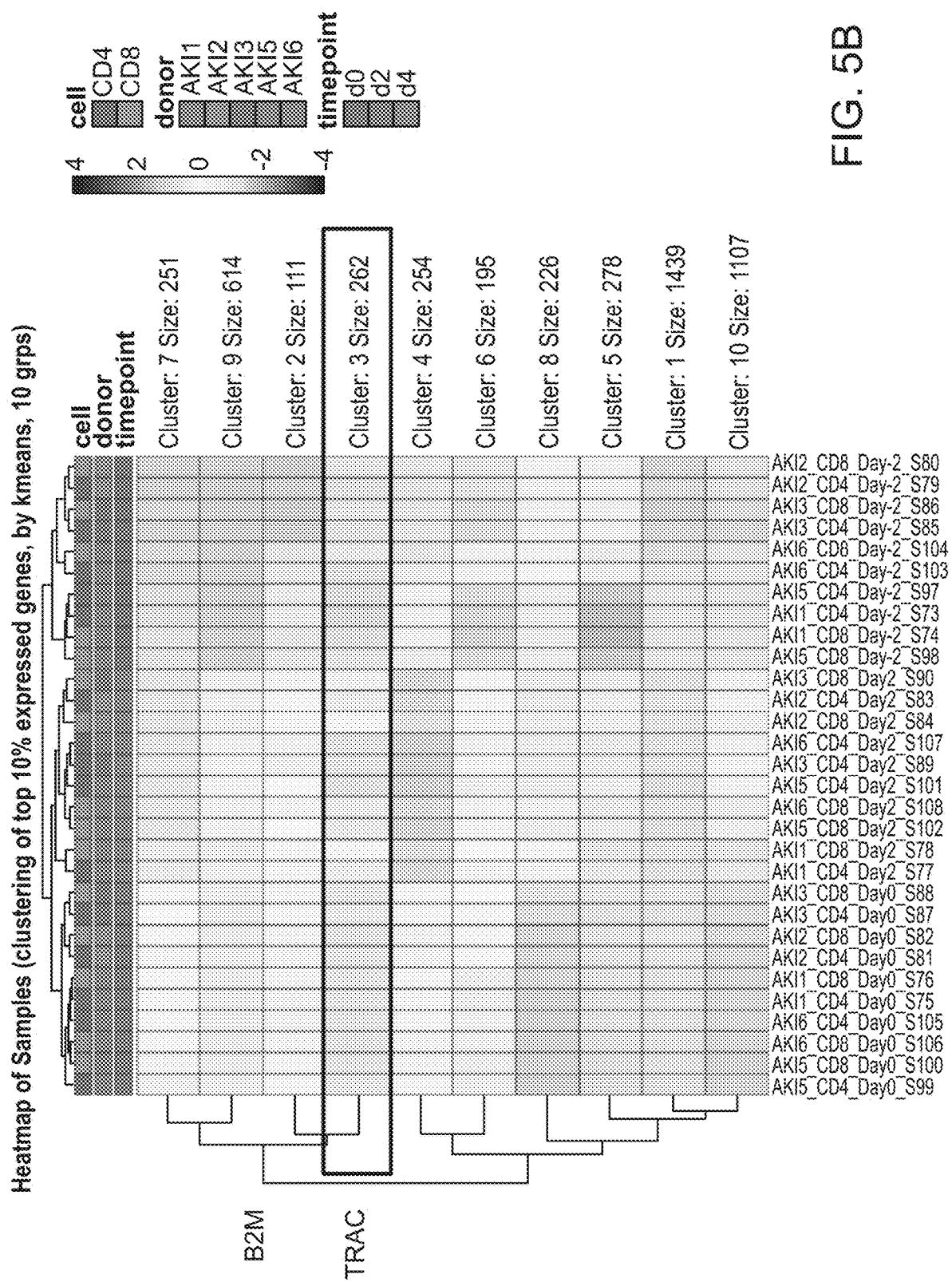

FIG. 4A and FIG. 4B show the processed RNA-seq data, showing that samples cluster based on activation status and by cell type. Donor 4 (AKI4) was identified as an outlier, as it clustered differently than the others, and was removed from remaining analysis. The transcript expression data from RNA-seq experiments on the 90 genes cited in the Roth, T. L. et al. paper was correlated to transcript expression data in Roth, T. L. et al. paper. (See FIG. 5A and FIG. 5B).

Figure 6:
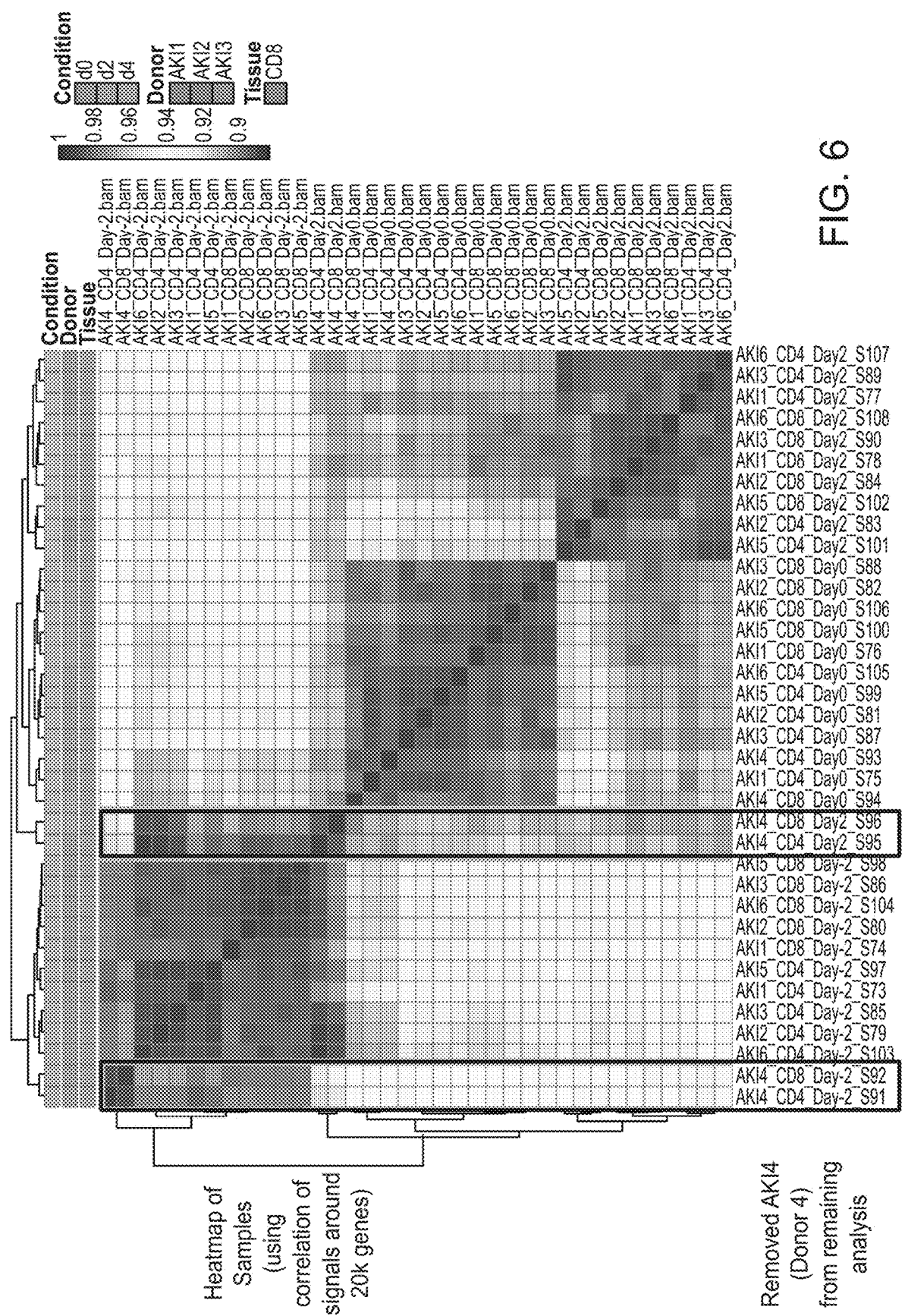
FIG. 6 includes a heatmap of samples generated with processed ATAC-seq data.
Figure 7A:
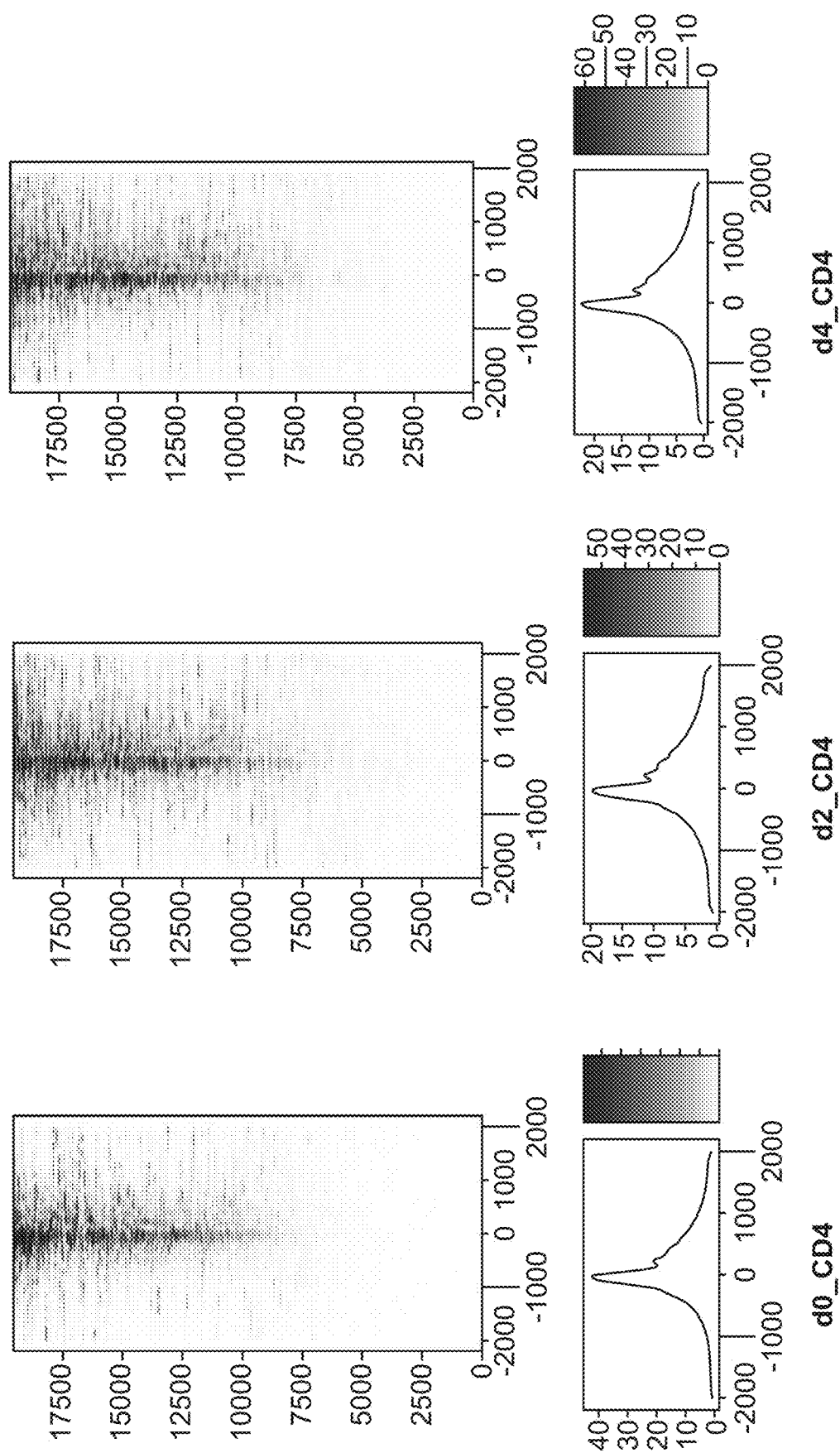
FIGS. 7A-7B includes plots depicting the signal enrichment at transcription start sites (TSS) (FIG. 7A) and peak size distribution (FIG. 7B), generated with processed ATAC-seq data for coding regions.
Figure 7B:
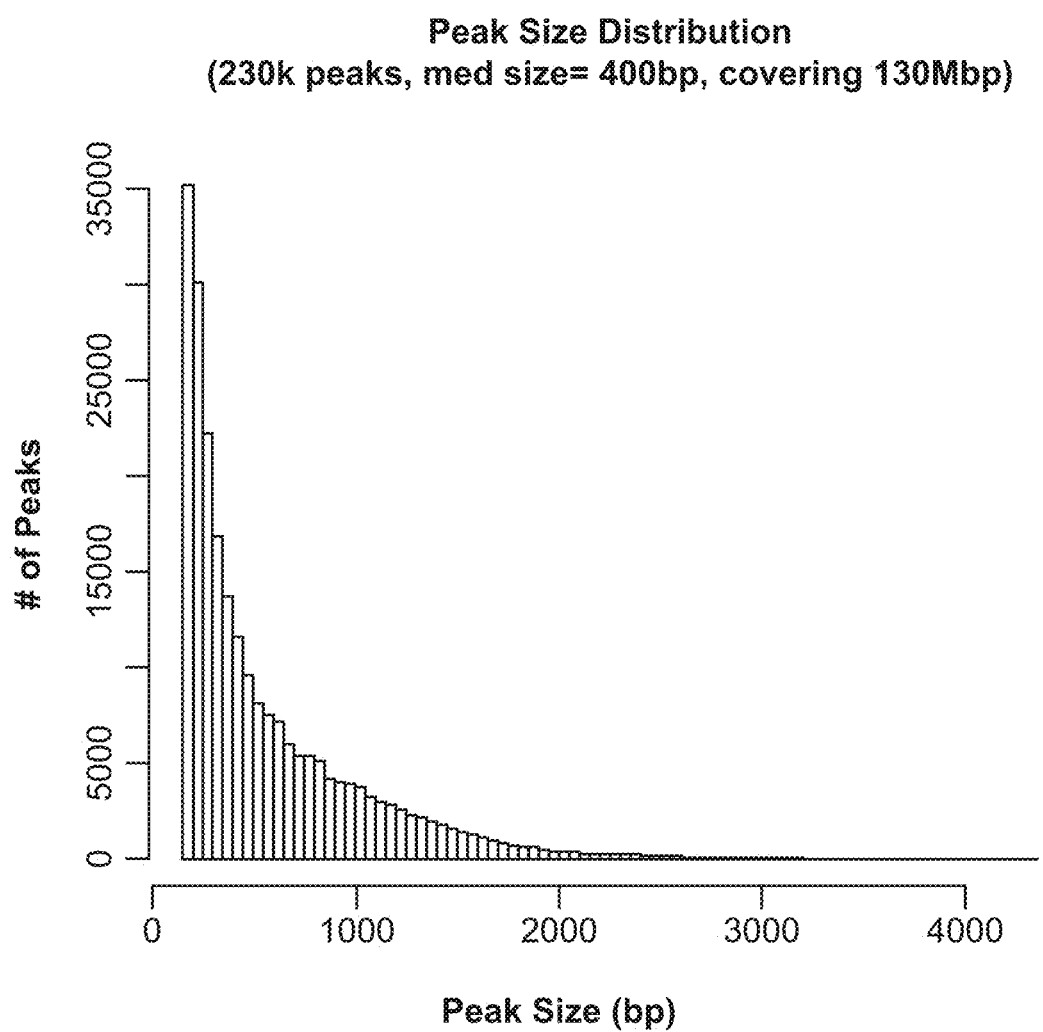
Figure 8:
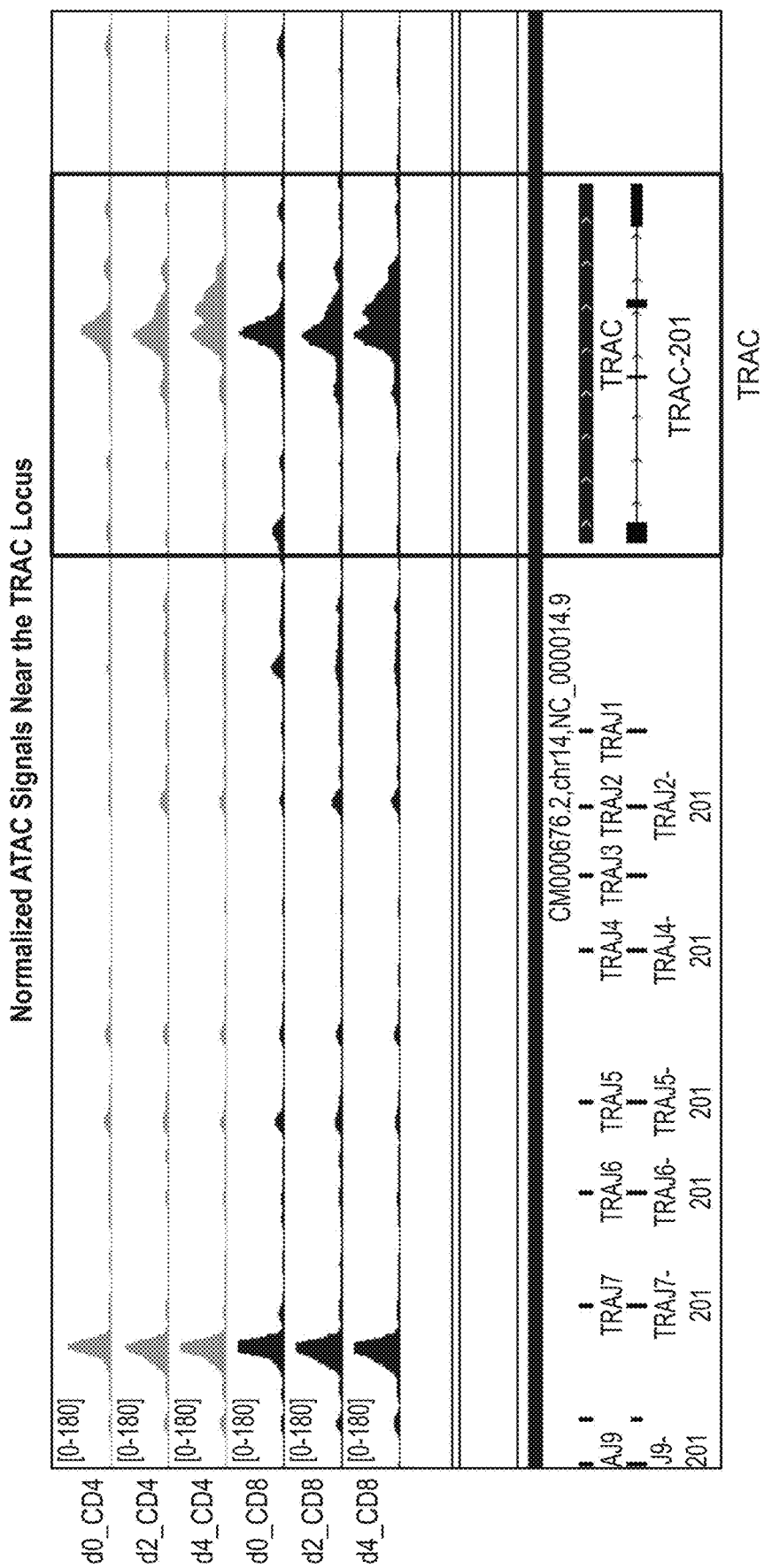
FIG. 8 includes a plot depicting the open chromatin regions around the TRAC locus.

FIG. 6 shows the process ATAC-seq data, which focused on the 10 kb area around the transcription start site (TSS). Again, donor 4 (AKI4) was identified as an outlier, based on expression profile in both CD4 and CD8 cells, and was removed from remaining analysis. The results of the remaining ATAC-seq analysis are shown in FIGS. 7A-8. The data in FIG. 7A for TSS enrichment scores also indicated that all libraries were high quality. The data on open chromatin regions around the TRAC locus revealed the highest signal near exon 3 rather than exon 1 (FIG. 8).

Figure 9:
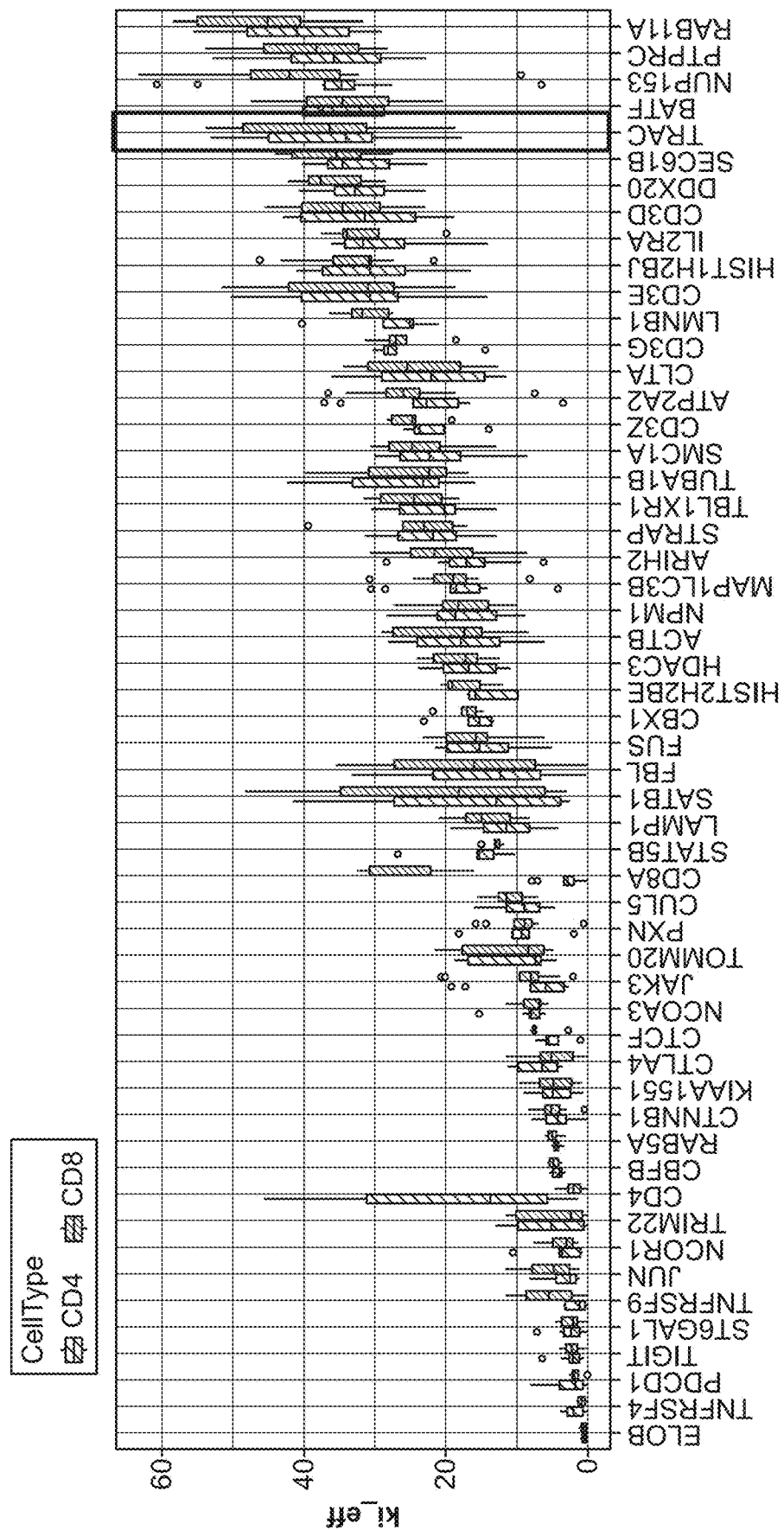
FIG. 9 includes a plot depicting KI (knock-in) efficiency for coding regions/genes with GFP as a reporter.
Figure 10:
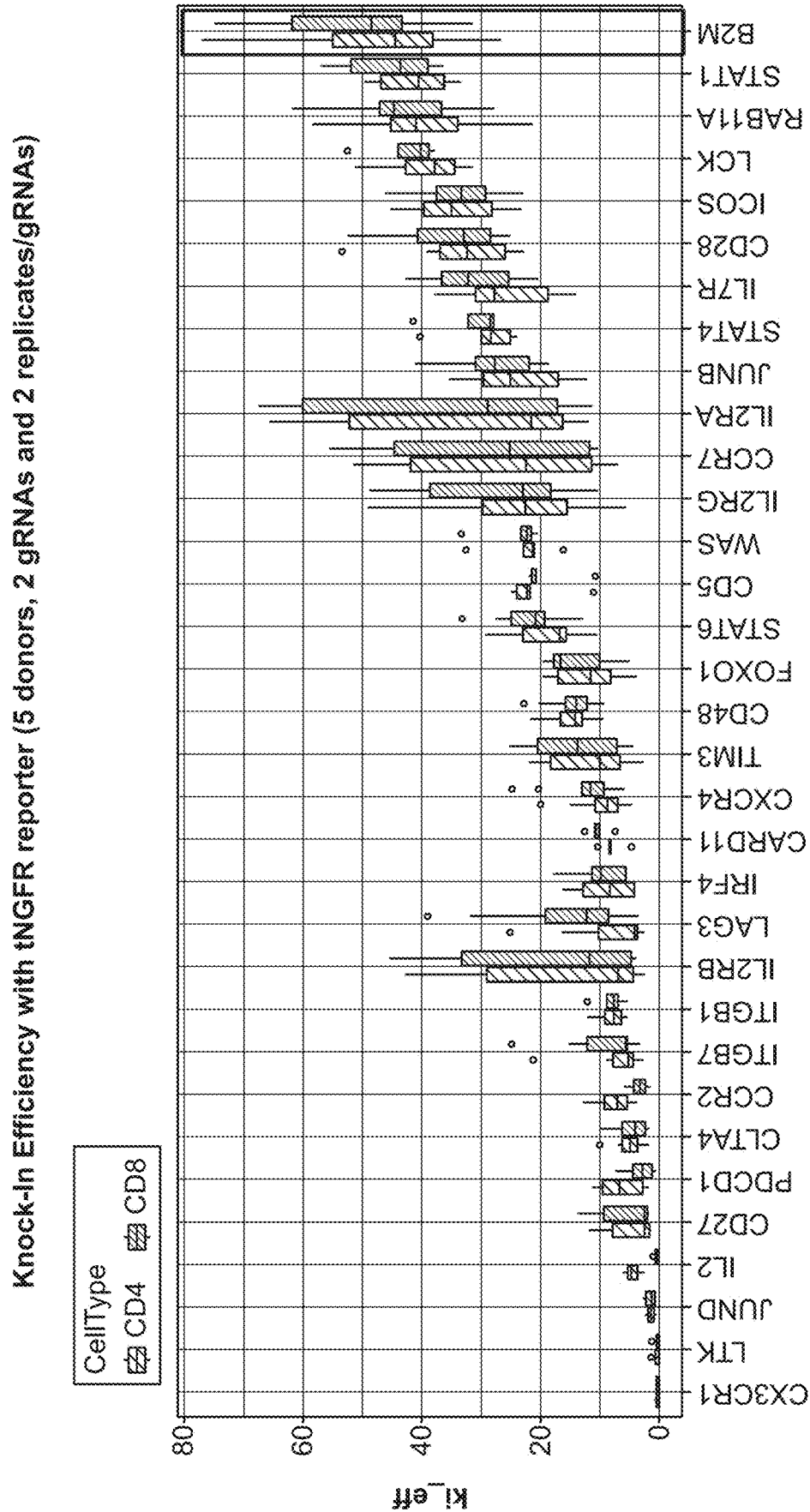
FIG. 10 includes a plot depicting KI efficiency for coding regions/genes with tNGFR as a reporter.

Determination of Knock-In Efficiency:

The KI efficiency results (obtained using the model described infra) based on the 5 donors, 2 gRNA, and 2 replicates/gRNAs from the Roth, T. L. et al. paper are shown in FIG. 9 and FIG. 10.

Figure 11:
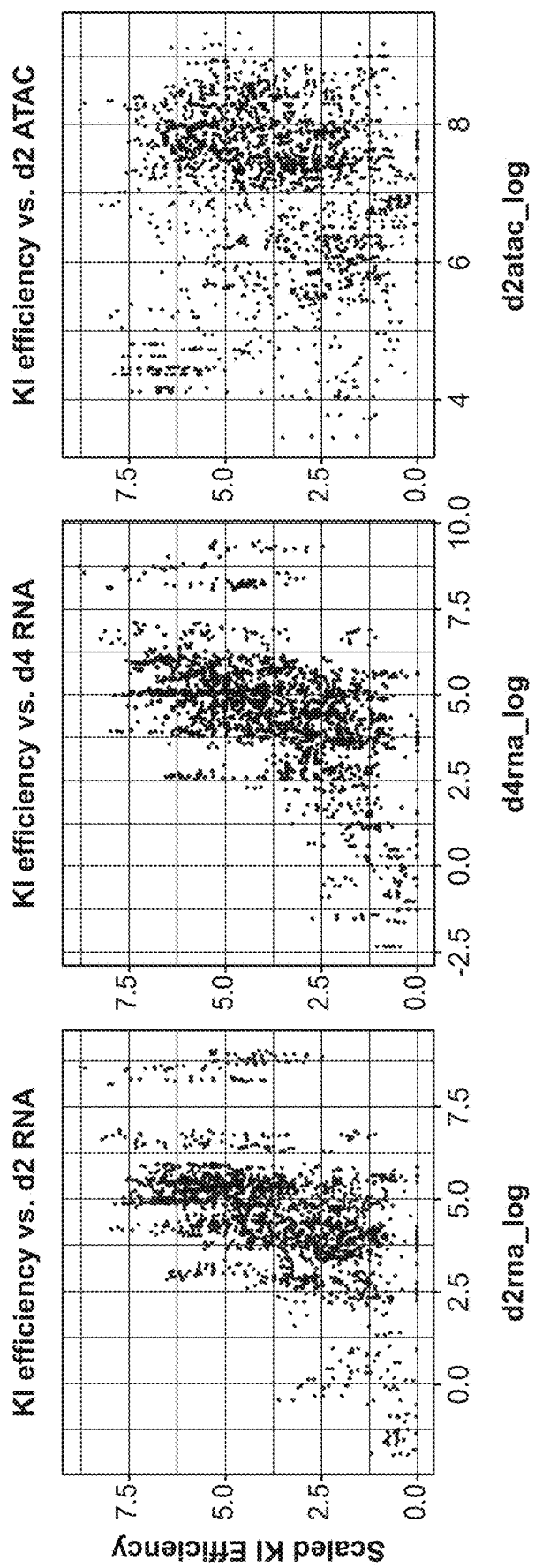
FIG. 11 includes plots showing scaled KI efficiency for 90 genes vs d2 (day-2) RNA-seq data, d4 (day-4) RNA-seq data and ATAC-seq data, utilized for the predictive linear model.

A linear model was built to estimate KI efficiency of approximately 90 genes using RNA-seq and ATAC-seq data. The linear model captured 33% of the variation in the data (i.e. $R^2$=0.33). FIG. 11 shows KI efficiency versus day 2 (d2) RNA-seq data, day 4 (d4) RNA seq data, and d2 ATAC data. The linear model was applied to remaining candidate genes to estimate their KI efficiency.

The candidate coding loci were selected by first ranking all genes in the pooled data sets by predicted KI efficiency, using RNA-seq expression data from d2 (day 2). Candidate coding loci were required to be stably expressed during T cell activation (e.g., <=2-fold expression change relative to day 0 (d0). The candidate loci also had to be accessible based on ATAC-seq data. Using that selection process/requirements, 16 well-characterized coding genes (with known functions) were selected as candidate genes. The knockout of these 16 would confer a benefit to the function of CAR T cells (e.g. B2M, CD5, SMAD2, PTPRC, CD3E). An additional 12 coding genes with high predicted KI efficiency and no apparent essential function (inert coding genes) were selected as candidate genes. (See Table 2).

TABLE 2

KI Candidate Loci selected

| Genes with Known Functions | | Inert Coding Genes |
|---|---|---|
| B2M (~70%) | CD2 | SUB1 |
| CD3E (~50%) | SMAD2 | EDF1 |
| PTPRC (~50%) | SLC38A1 | CAPNS1 |
| CD3G (~30%) | TIGIT | SRP14 |
| | SOCS1 | RTRAF |
| | PTPN2 | APRT |
| | CBLB | PTPRCAP |
| Tested in Roth, T.L. et al paper (reported editing efficiency from Roth, T.L. et al paper) | PTEN | SRSF9 |
| | PTPN6 | FTL |
| | CD5 | TRIM28 |
| | TET2 | SERF2 |
| | TRAC | RPS23 |

Example 2: Identification of Knock-In Loci in Gene Deserts

The criteria for selection of candidate loci in non-coding regions or gene deserts is summarized in Table 3.

TABLE 3

Criteria used for identification of candidate knock-in loci within non-coding regions

| Criteria | Detailed Requirements | Datasets Considered for identification of loci |
|---|---|---|
| KI efficiency | Accessible chromatin | Bulk ATAC-seq data at d0, d2, d3 and d4: (i) data derived from Roth, T. L., et al. 2019. (Rapid discovery of synthetic DNA sequences to rewrite endogenous T cell circuits. bioRxiv, 604561.); and (ii) internally generated data |

TABLE 3-continued

Criteria used for identification of candidate knock-in loci within non-coding regions

| Criteria | Detailed Requirements | Datasets Considered for identification of loci |
|---|---|---|
| Safety | >10 kb from cancer-related genes or TADS<br>>10 kb from any miRNA/functional small RNAs<br>>10 kb from any 5' gene end<br>>10 kb from any regulatory regions (ultra-conserved elements, enhancers) | Ensembl genes<br>Annotated oncogenes and tumor suppressors from TCGA<br>Annotated enhancers from Encode and papers |

To select candidate regions within the non-coding regions, the inventors here started by looking in highly accessible regions of the genome (10 kb windows). The most accessible region overlapped with (i) annotated protein coding genes (>50% accessible regions), (ii) pseudogenes and noncoding RNAs (~20% accessible regions), and (iii) enhancer/regulatory regions (~20% accessible regions). The candidate genes were required to be <10 kb from the coding regions. A few regions that overlapped with long intergenic noncoding RNAs (lincRNAs) but did not have apparent function in T cells were also considered.

Examples of other criteria that have been used in the art for selection of SHS are described, for example in Pellenz, S., et al. (2019). New human chromosomal sites with "safe harbor" potential for targeted transgene insertion. Human gene therapy, 30(7), 814-828, the relevant disclosures of which are herein incorporated by reference in their entirety.

Figure 12:
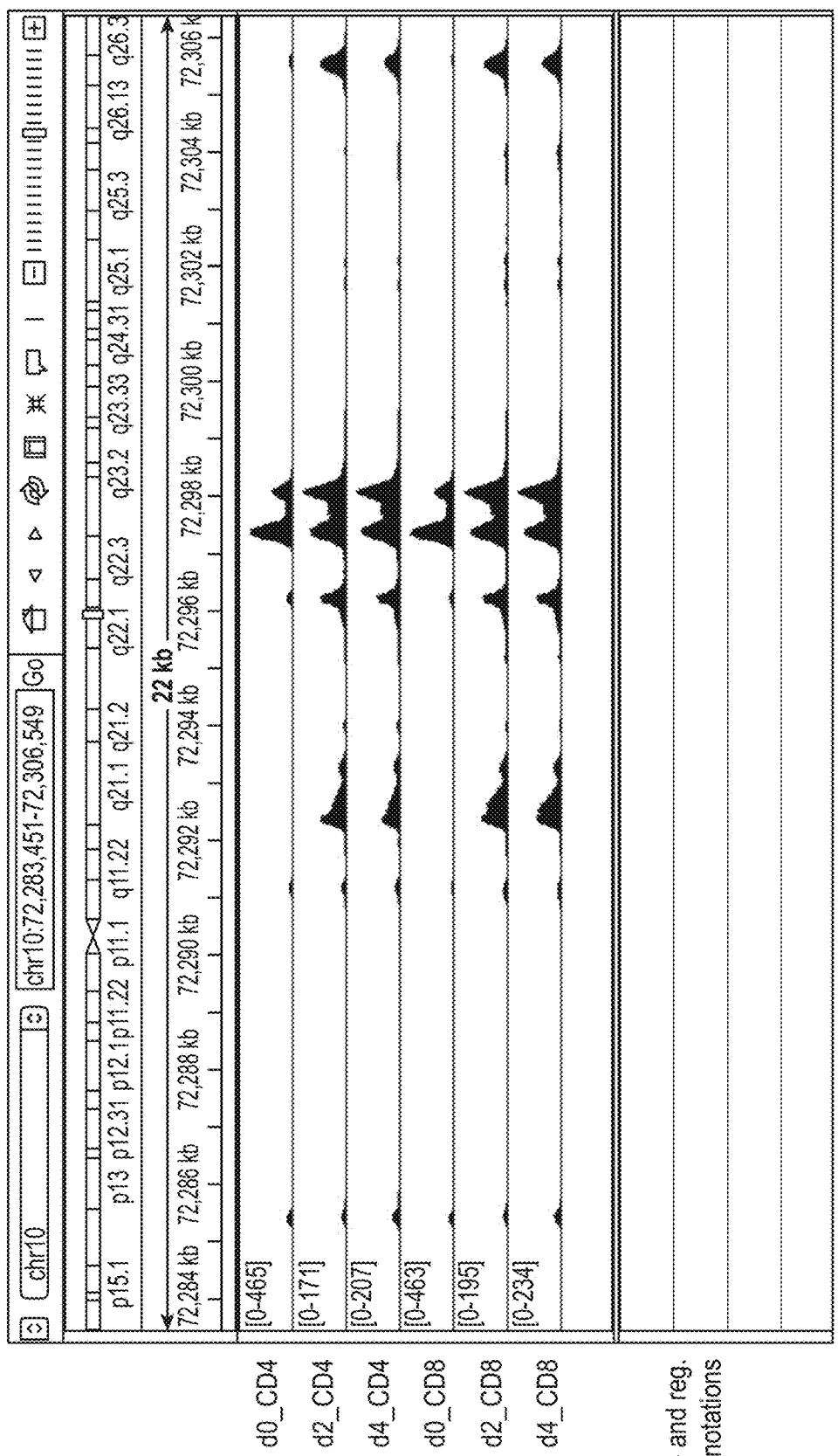
FIG. 12 includes a plot showing chromatin accessibility for a top candidate non-coding region, measured using ATAQ sequencing.

FIG. 12 is a plot showing the normalized ATAQ SEQ data for a top candidate non-coding region.

Using the above-described selection process/requirement, 11 candidate regions in gene deserts were selected. In total, there were 39 KI candidate loci, including those in coding and non-coding regions that would be evaluated as safe harbor loci (predicted loci).

Example 3: Experimental Evaluation of Predicted Loci

Materials
120 sgRNAs were ordered from Synthego, 3 sgRNAs per region, and editing efficiency was assessed by next generation sequencings (NGS).
  87 targeted coding genes
  33 targeted gene deserts
189 constructs were synthesized by Genscript
  Homology arm: 450 bp each
  eGFP was used as the reporter
  Vector backbone: pUC57-Kan backbone
  78 with endogenous promoters
  111 with EF1a-HTLV promoter
Constructs were sequence verified by Genscript and majority were internally verified by sequencing. The sgRNA sequences are provided in Table 4 and the construct sequences are provided in Table 5.
Methods
To evaluate the effectiveness of the predicted loci, the following were used:
  (87 endogenous constructs+120 exogenous construct)
    *2=414 wells+Controls=460
  3 donors, 2 replicates at 3 time points: wk1 (d6=day 6), wk3 (d21=day 21) and wk4 (d28=day 28)
Controls
  DNA-only (no ribonucleoprotein (RNP)): episomal expression (n=8)
  DNA+non-targeting guides+RNP: to check if DNA delivery is more efficient with RNP (n=8)
  pMax GFP was measured to check if transfection is ok (n=3).
  WT cells with no electroporation
  WT cells with electroporation
  Controls were spread out across plates.
  Cells were electroporated without RNP/HDR to check if cell counting makes sense.
  2 more donors were added and changed to 3 replicates at 1 time point: wk1 (d6)
  FACS panel: GFP, TCR, Zombie
  Washed every 3 wells.

The secondary data collected included: RNA-seq data: at d0, d2, and d4 (to determine stable expression) and ATAC-seq data: at d2 (to identify activated cells). The methods used for conducting the RNA-seq and ATAC-seq experiments are in Roth, T. L., et al. 2019. (Rapid discovery of synthetic DNA sequences to rewrite endogenous T cell circuits. bioRxiv, 604561), which is herein incorporated by reference in its entirety.

Automated gating was performed on FACS data, using .fcs files. For constructs with endogenous promoters, all 5 donors and all 3 time points were used. For constructs with EF1a promoter, used 3 donors (donors 1-3) and 2 time points (wk3 and wk4).

To summarize data, wells with a % KI efficiency (% GFP high cells)<=10% (likely a gating error, experimental error or minimal integration) were removed. Loci were then ranked by median expression among donors and median % KI efficiency among donors.

Loci significance was calculated using robust rank aggregation, which was the methodology used for consistent ranking of loci among donors and time points. Methods for conducting robust rank aggregation are known in the art. (See, for example, Kolde, R., et al. (2012). Robust rank aggregation for gene list integration and meta-analysis. Bioinformatics (Oxford, England), 28(4), 573-580, the disclosure of which is herein incorporated by reference in its entirety).

Results
The results from the analysis of controls and experimental groups is shown in FIGS. 13A-25.

Figure 13A:
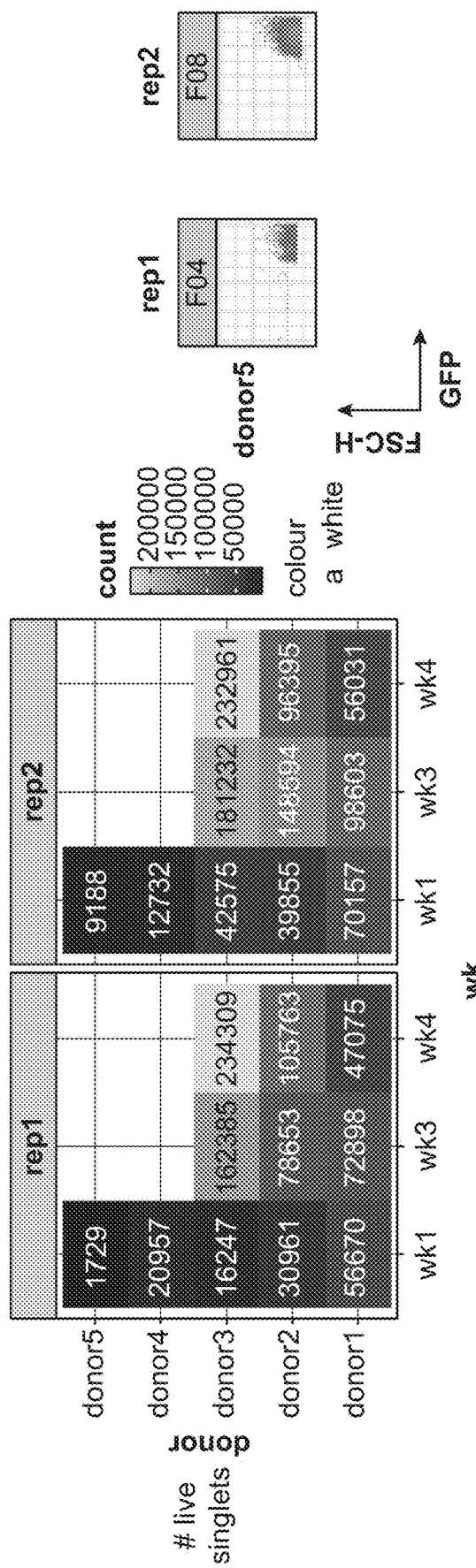
FIG. 13A includes plots showing the cell counts for GFP controls used for the evaluation of candidate KI loci.
Figure 13B:
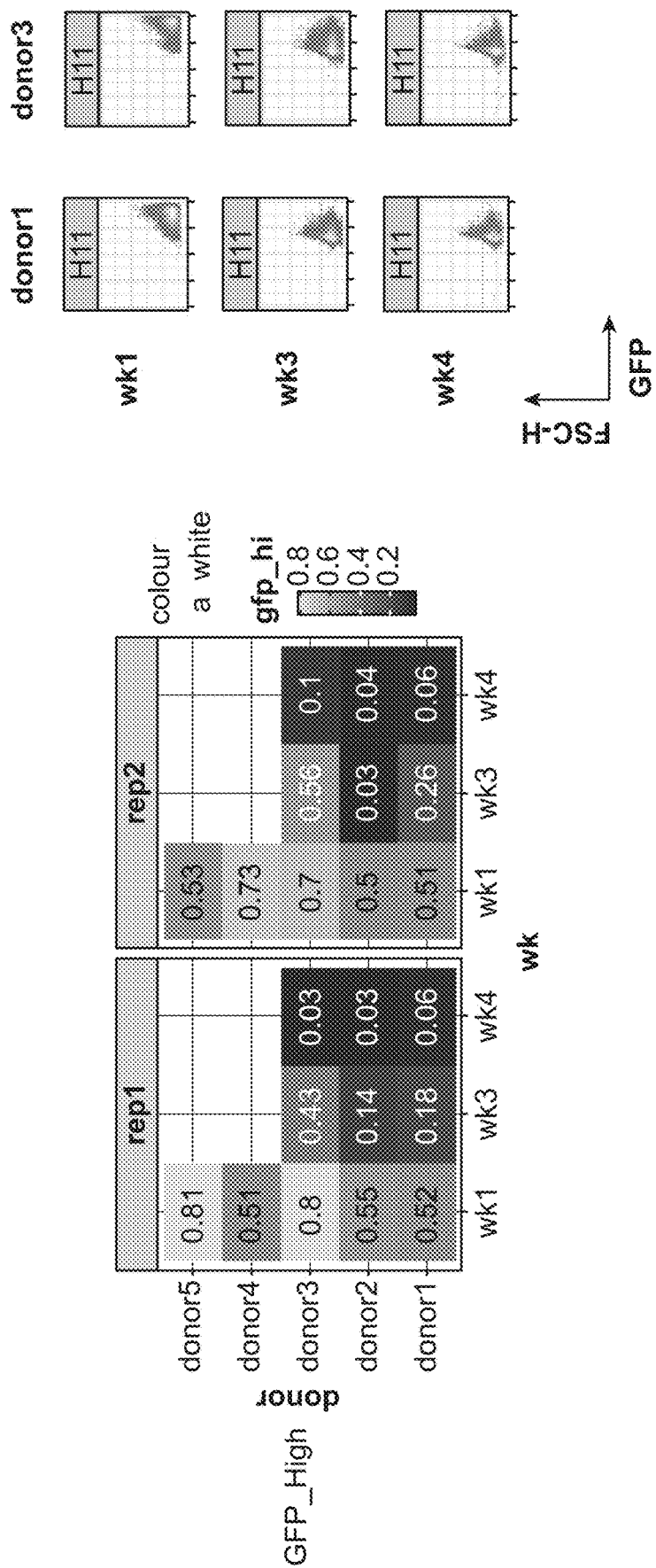
FIG. 13B includes pmax (GFP_high) readings for GFP controls used for the evaluation of candidate KI loci.
Figure 14A:
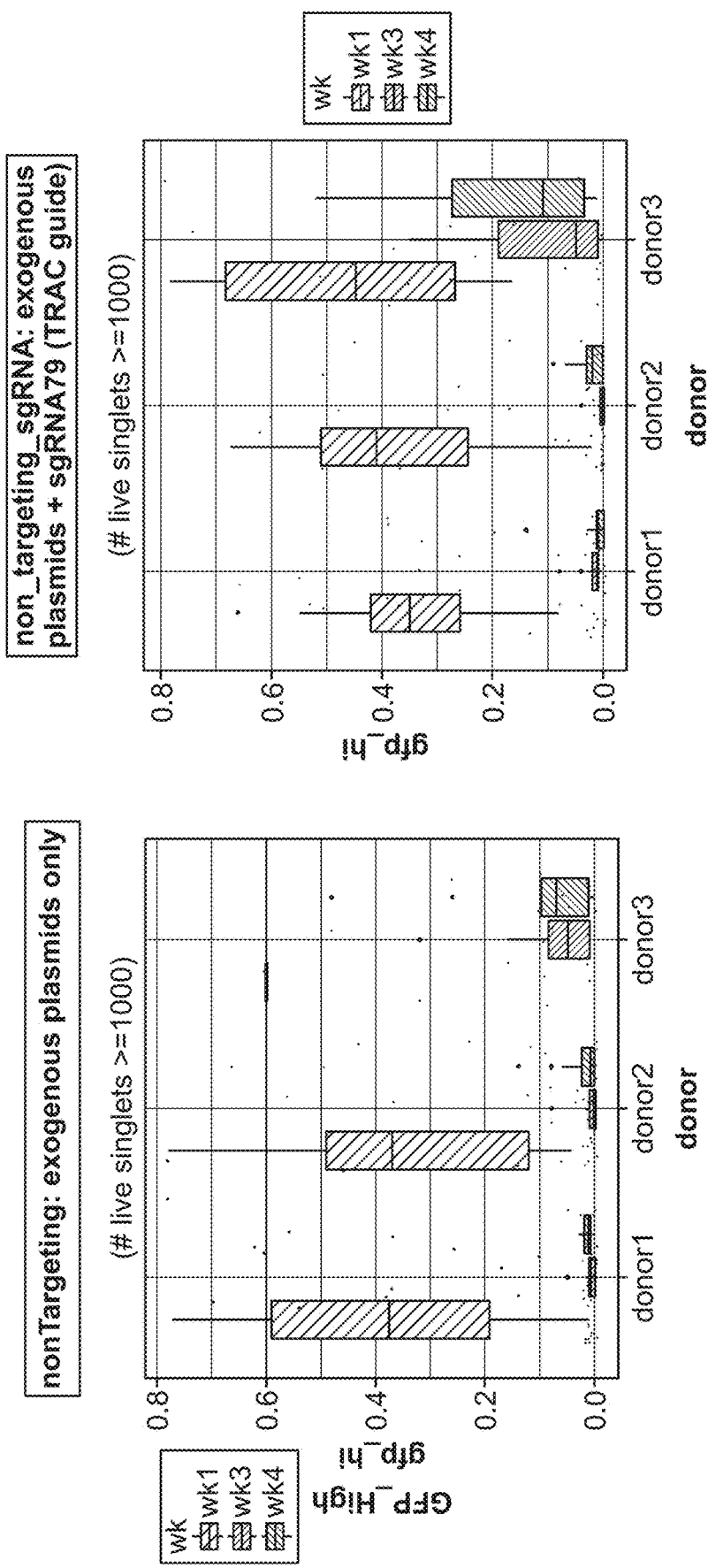
FIG. 14A includes plots showing the maximum episomal GFP expression (GFP_high) readings for non-targeting controls.
Figure 14B:
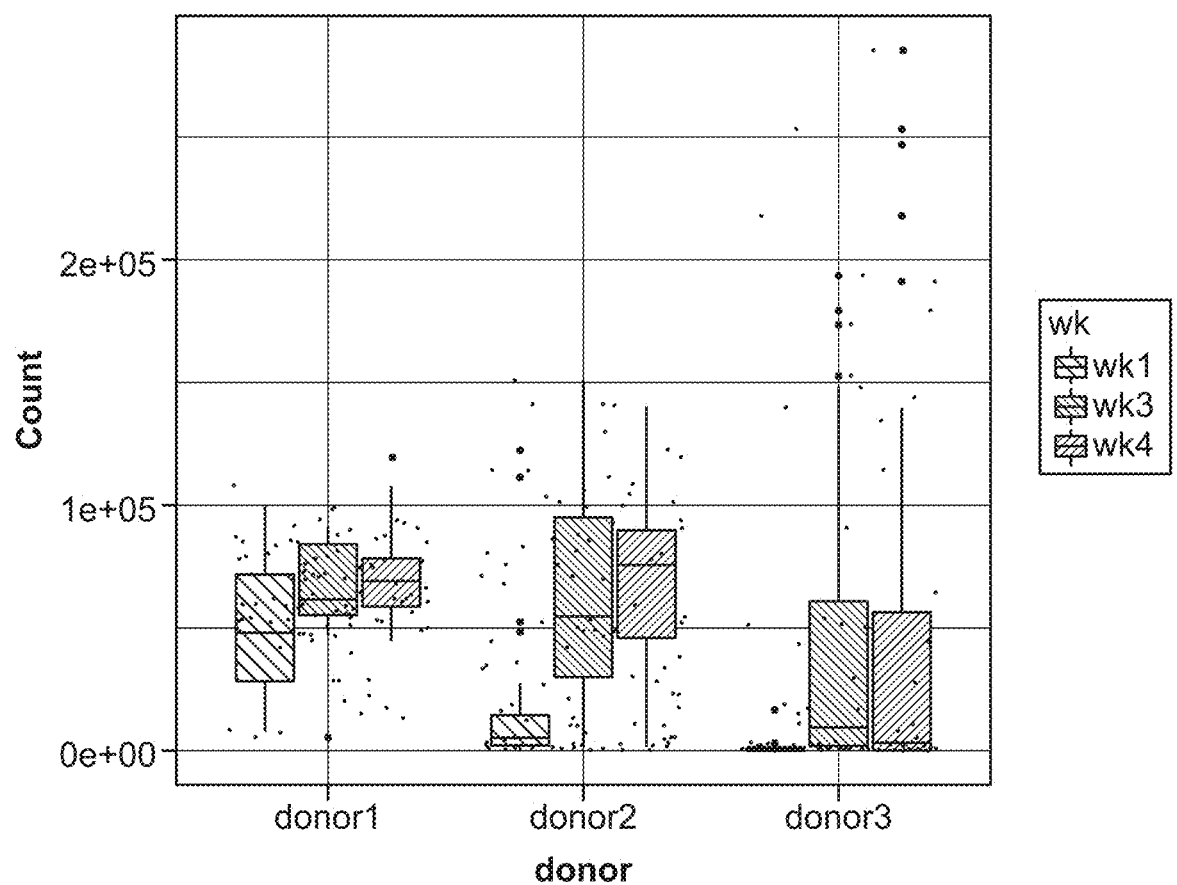
FIG. 14B includes the cell count for non-targeting controls from donors 1, 2, and 3.

The results of the pmax_GFP control experiments revealed that donor 5 had significantly higher cell count than other donors. Generally, the GFP_high readings decreased over time, as expected. (FIGS. 13A and 13B).

Figure 15:
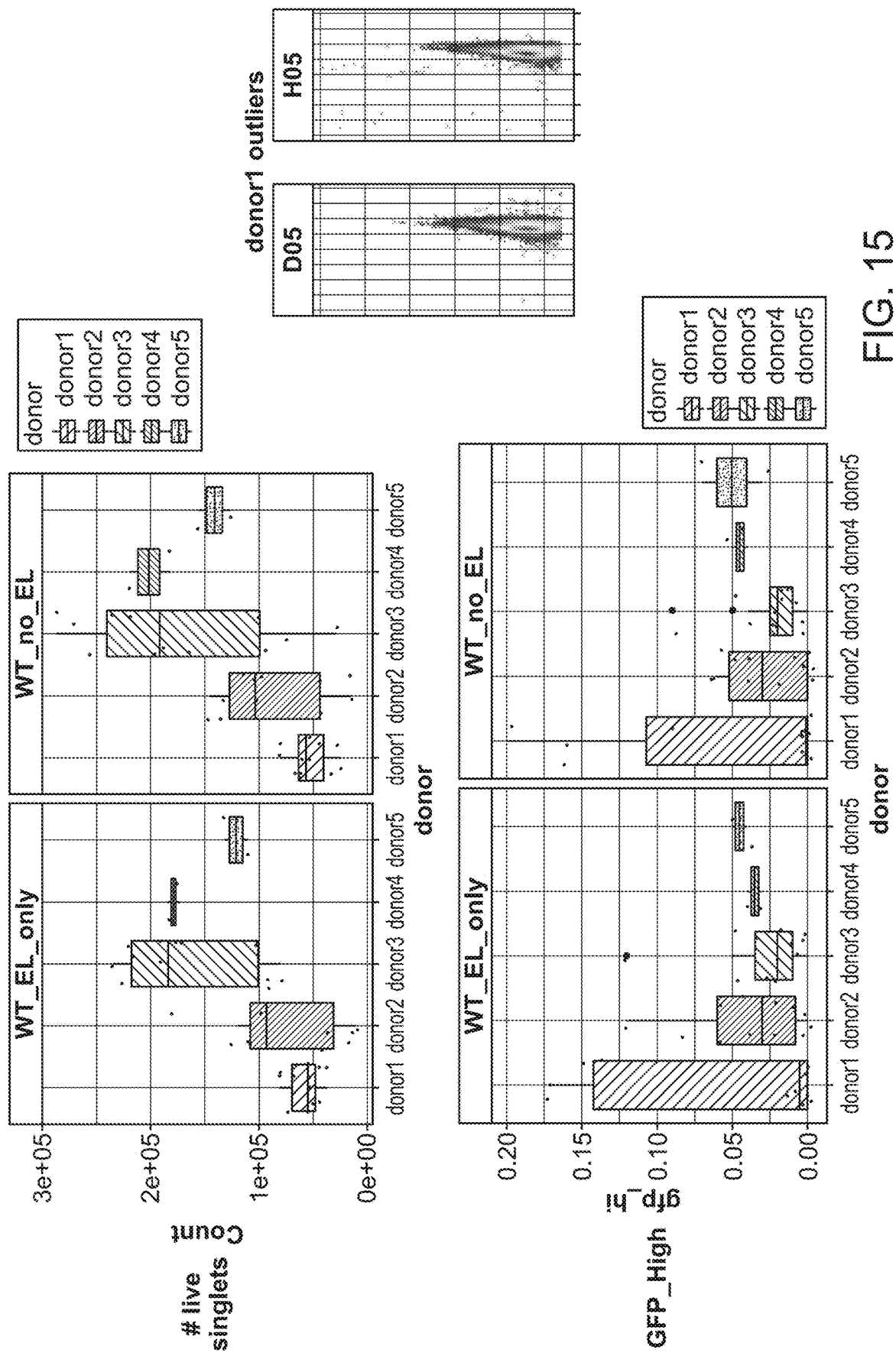
FIG. 15 includes the cell count and maximum GFP expression (GFP_high) readings for WT controls.

Experiments to analyze non-targeting controls for changes in episomal GFP expression, revealed that episomal GFP expression decreased to less than 0.05 over time. (FIGS. 14A and 14B) Some of the outliers were attributed to gating errors, which were most severe in donor 3. WT control experiments also exhibited <0.05 GFP_high readings, as expected (FIG. 15).

Figure 16:
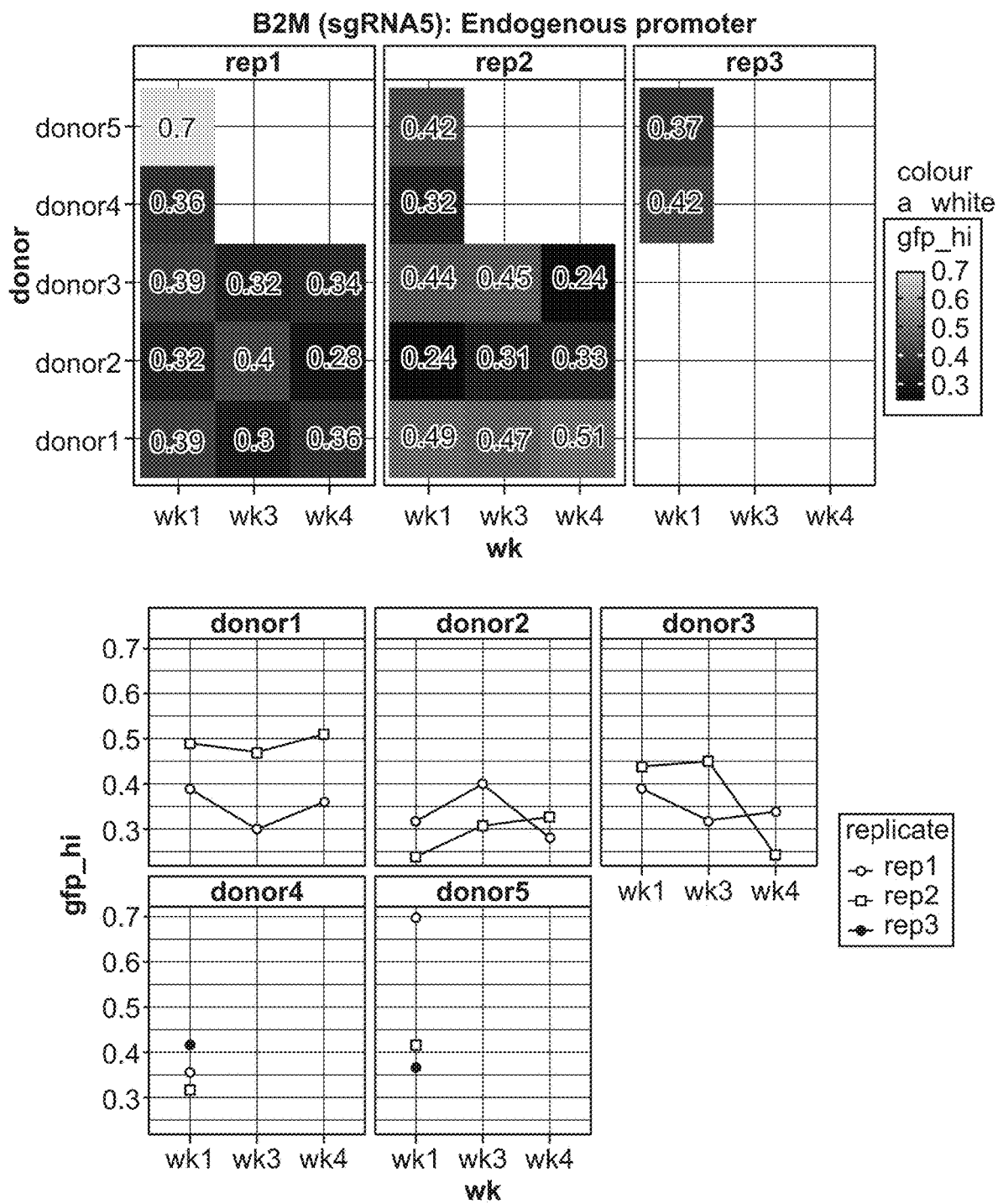
FIG. 16 includes plots showing the cell count and maximum GFP expression (GFP_high) readings when using sgRNA5, which targets a B2M safe harbor locus, and the construct expression was driven by an endogenous promoter.
Figure 17:
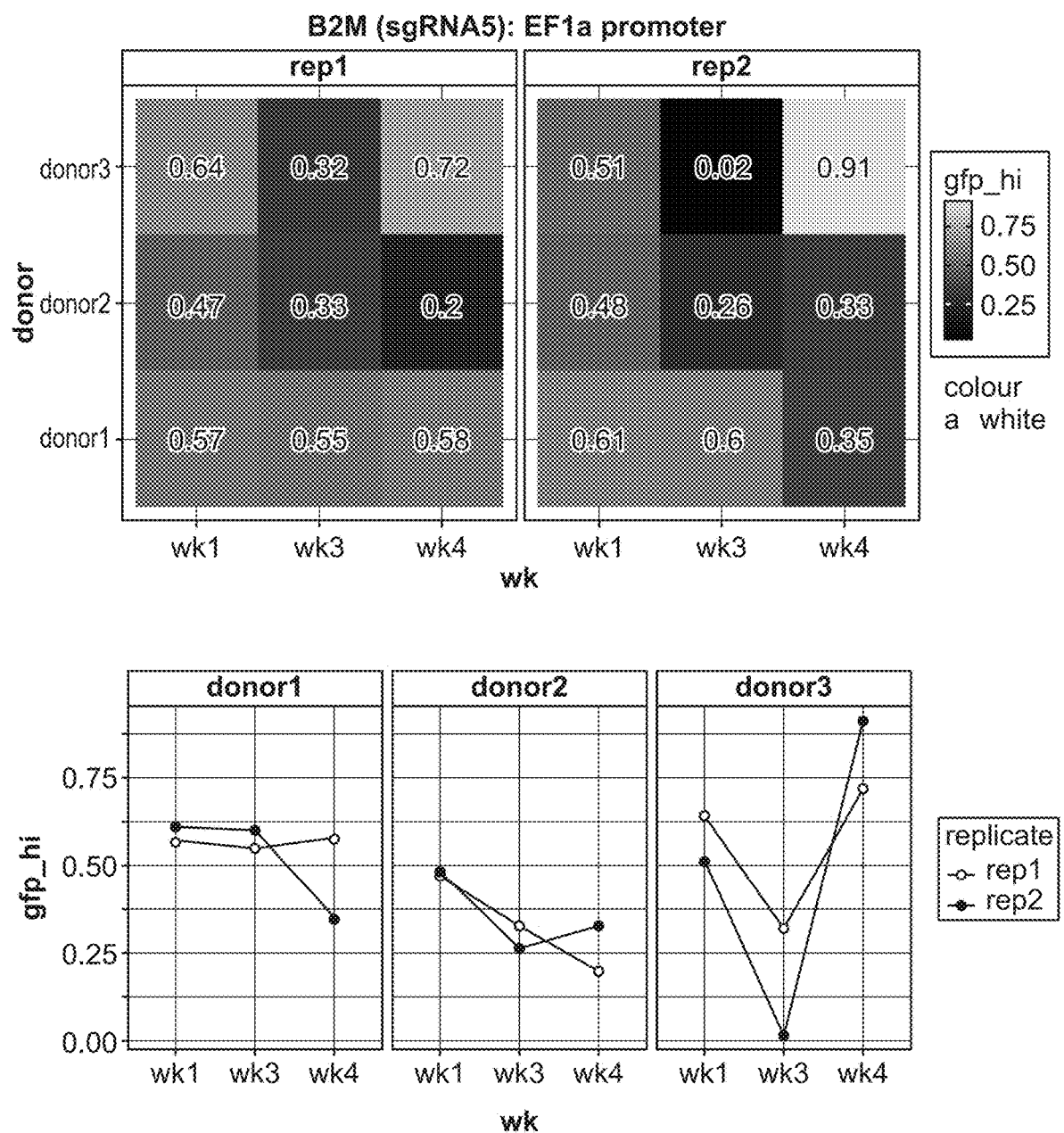
FIG. 17 includes plots showing the cell count and maximum GFP expression (GFP_high) readings when using sgRNA5, which targets a B2M safe harbor locus, and the construct expression was driven by an EF1a promoter.

As shown in FIG. 16 and FIG. 17, there was a more consistent trend among donors when using sgRNA5 to target the B2M safe harbor locus.

Figure 18:
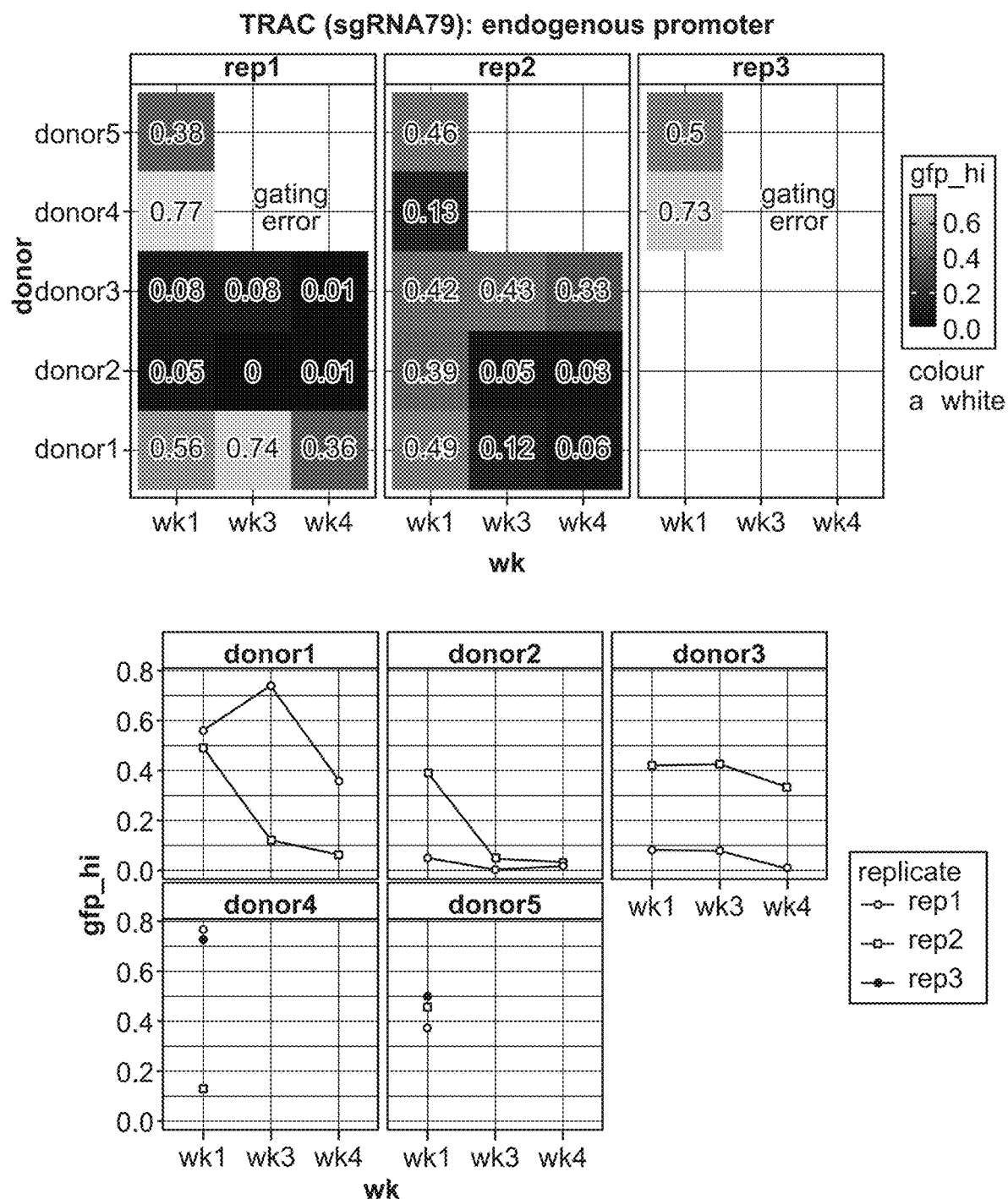
FIG. 18 includes plots showing the cell count and maximum GFP expression (GFP_high) readings when using sgRNA79 to target a TRAC safe harbor locus, and the construct expression was driven by an endogenous promoter.
Figure 18:
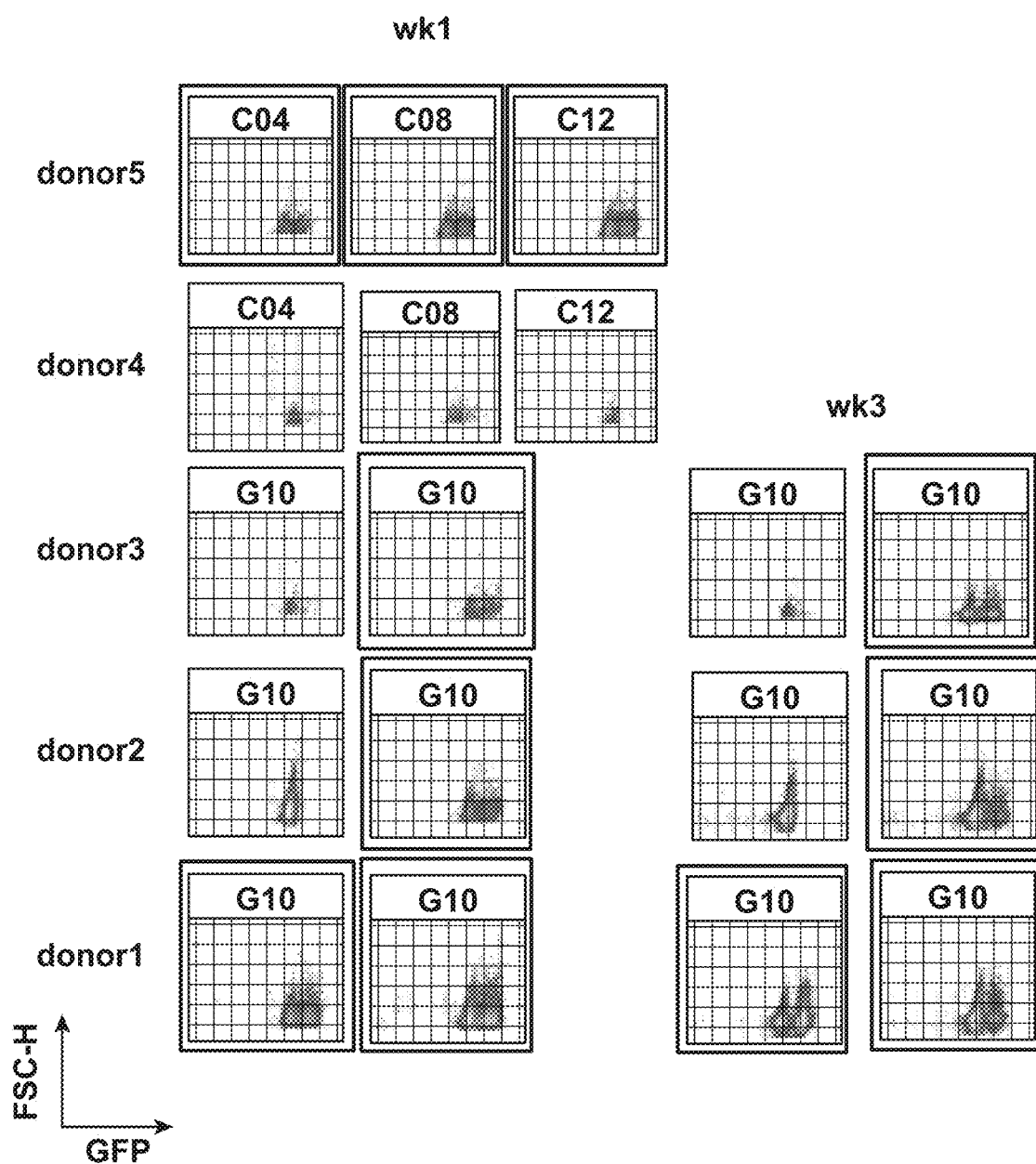
Figure 19:
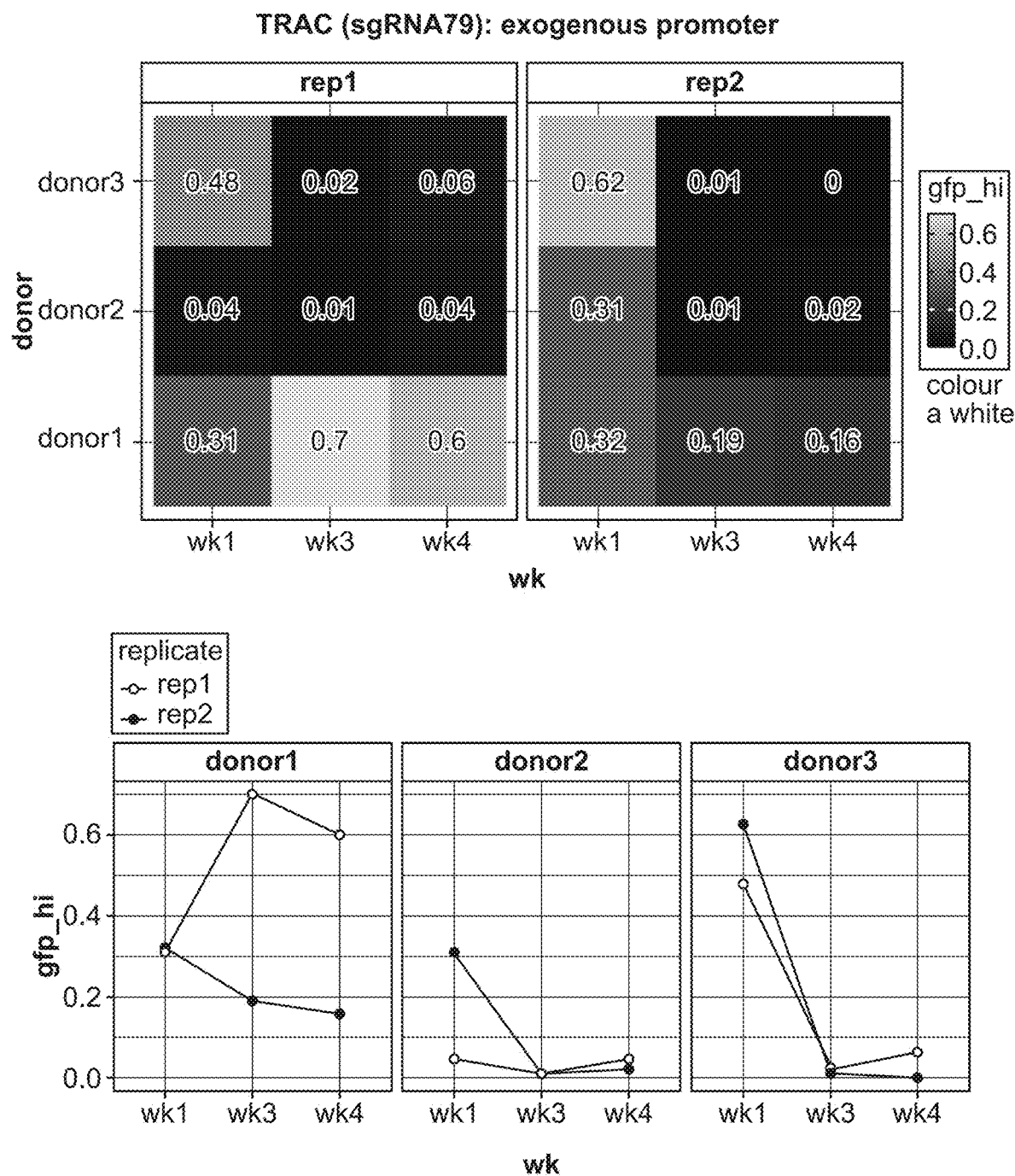
FIG. 19 includes plots showing the cell count and maximum GFP expression (GFP_high) readings when using sgRNA79, which targets a TRAC safe harbor locus, and the construct expression was driven by an exogenous promoter.
Figure 19:
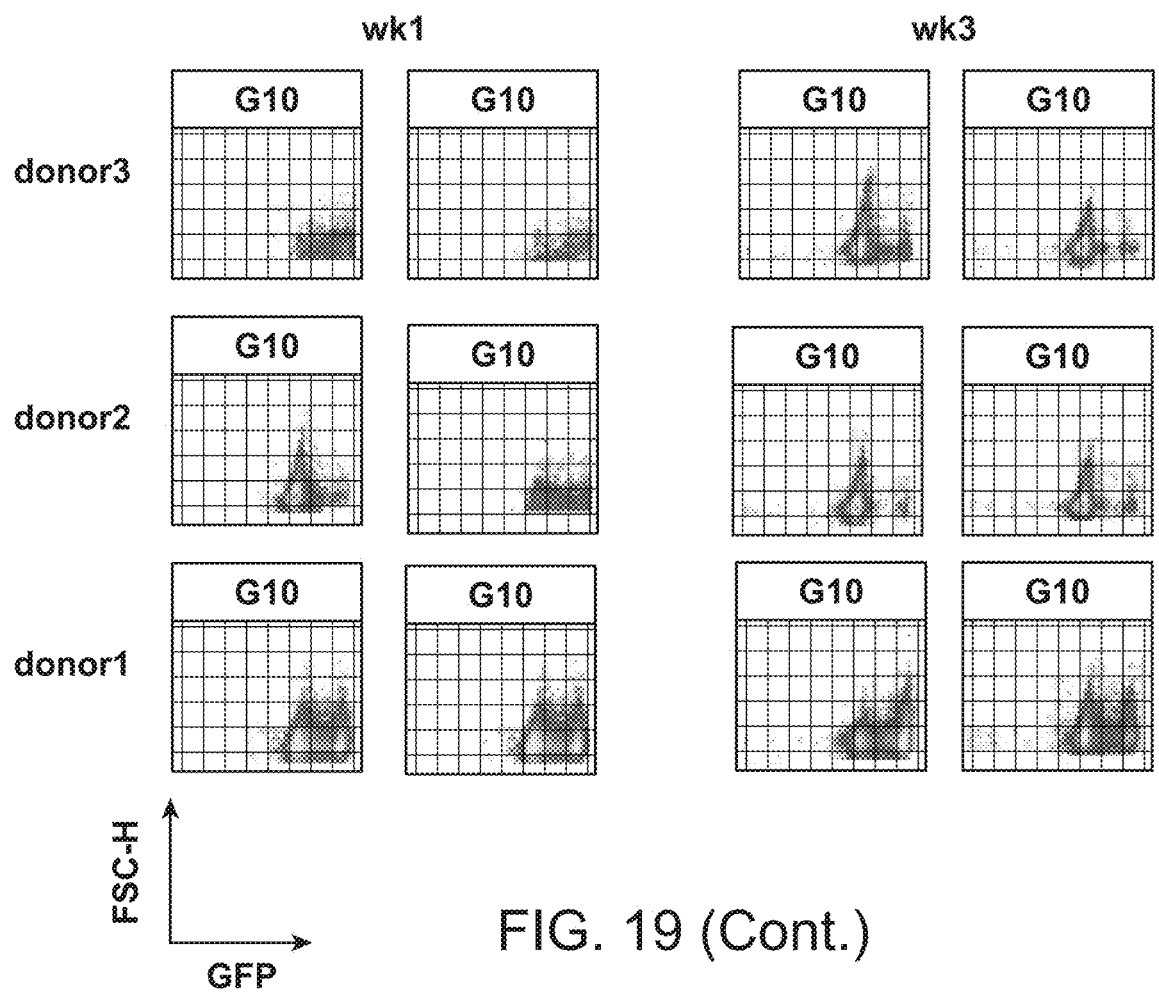
Figure 20:
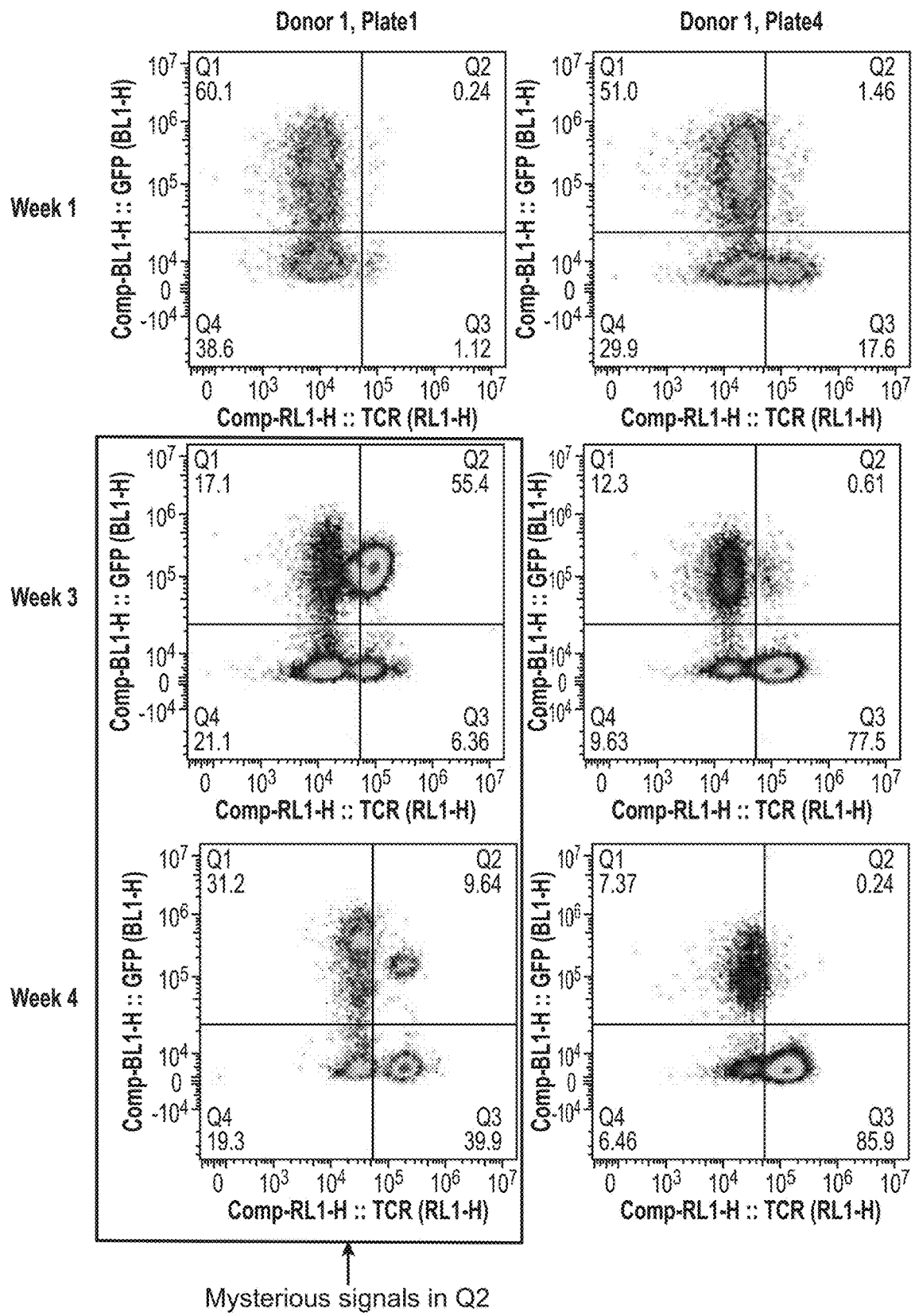
FIG. 20 includes plots showing TCR (T cell receptor) vs. GFP among all donors and time points when using sgRNA79, and the construct is driven by an endogenous promoter.
Figure 21:
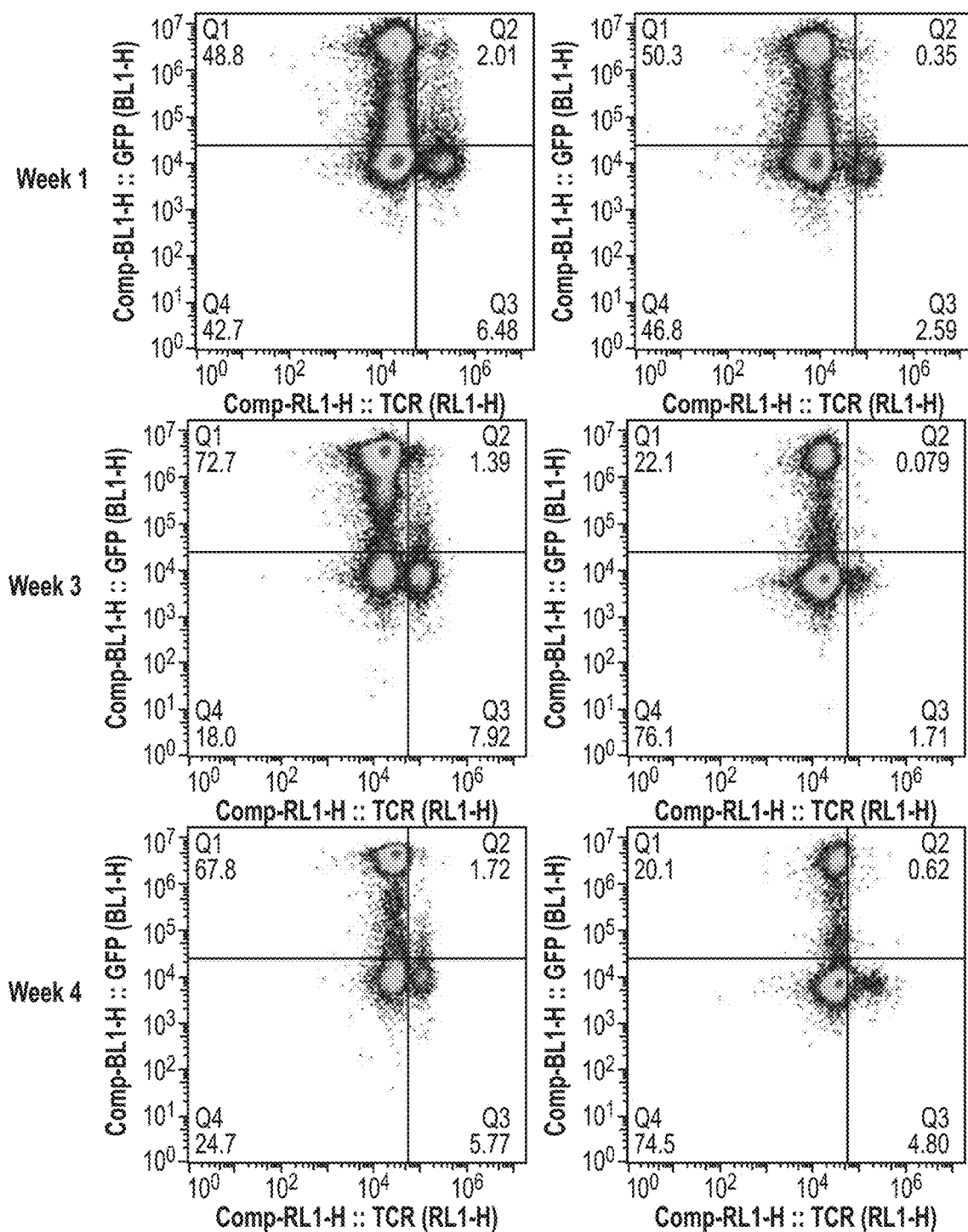
FIG. 21 includes plots showing TCR vs. GFP among all donors and time points when using sgRNA79 and the construct is driven by an exogenous promoter.
Figure 22:
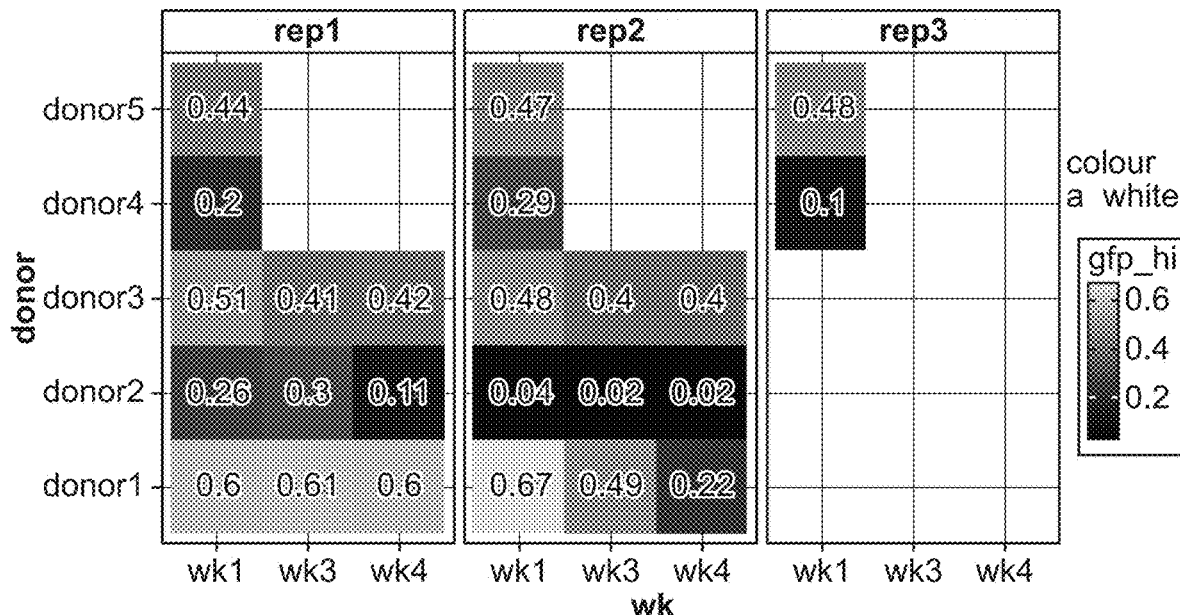
FIG. 22 includes plots showing the cell count and maximum GFP expression (GFP_high) readings when using sgRNA83, which targets a TRAC safe harbor locus, and the construct expression was driven by an endogenous promoter.
Figure 22:
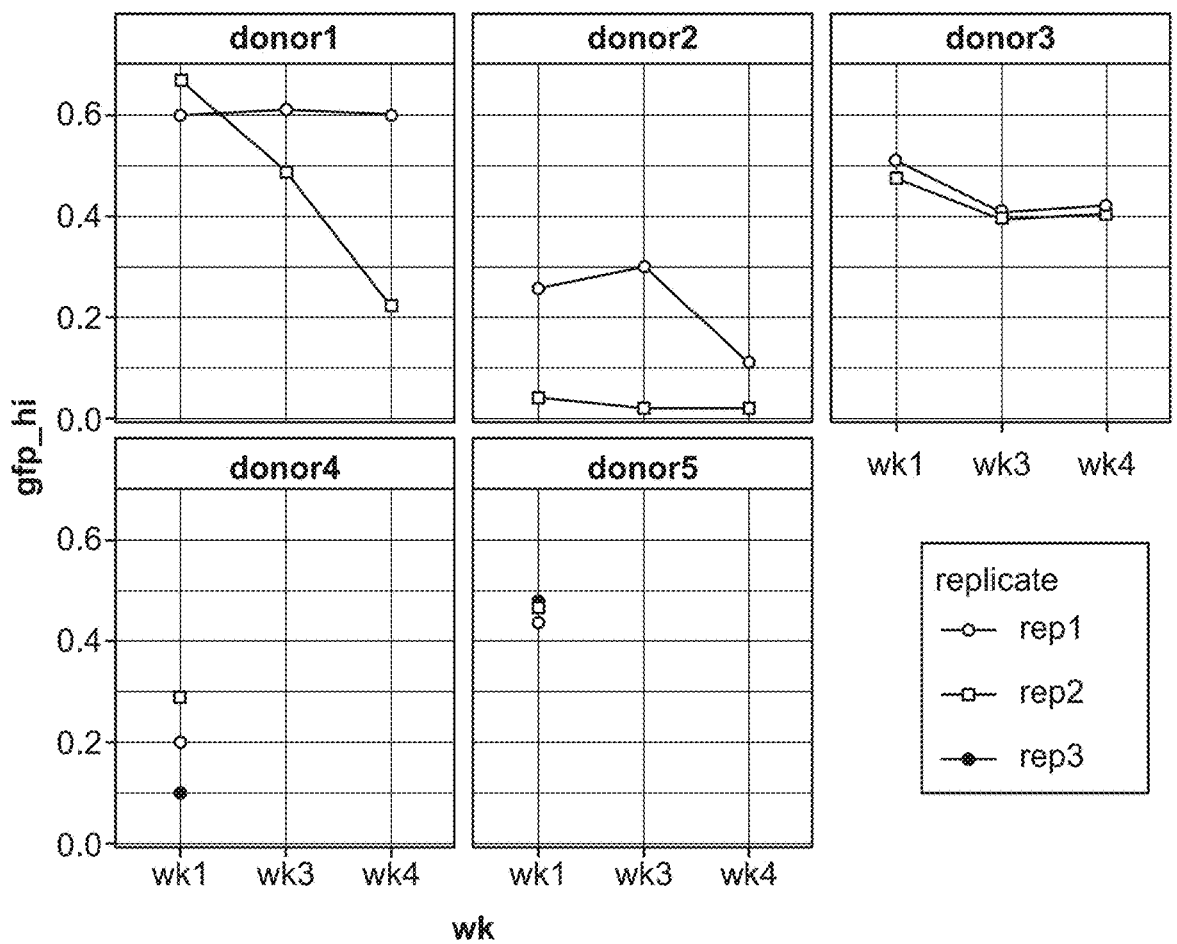
Figure 22:
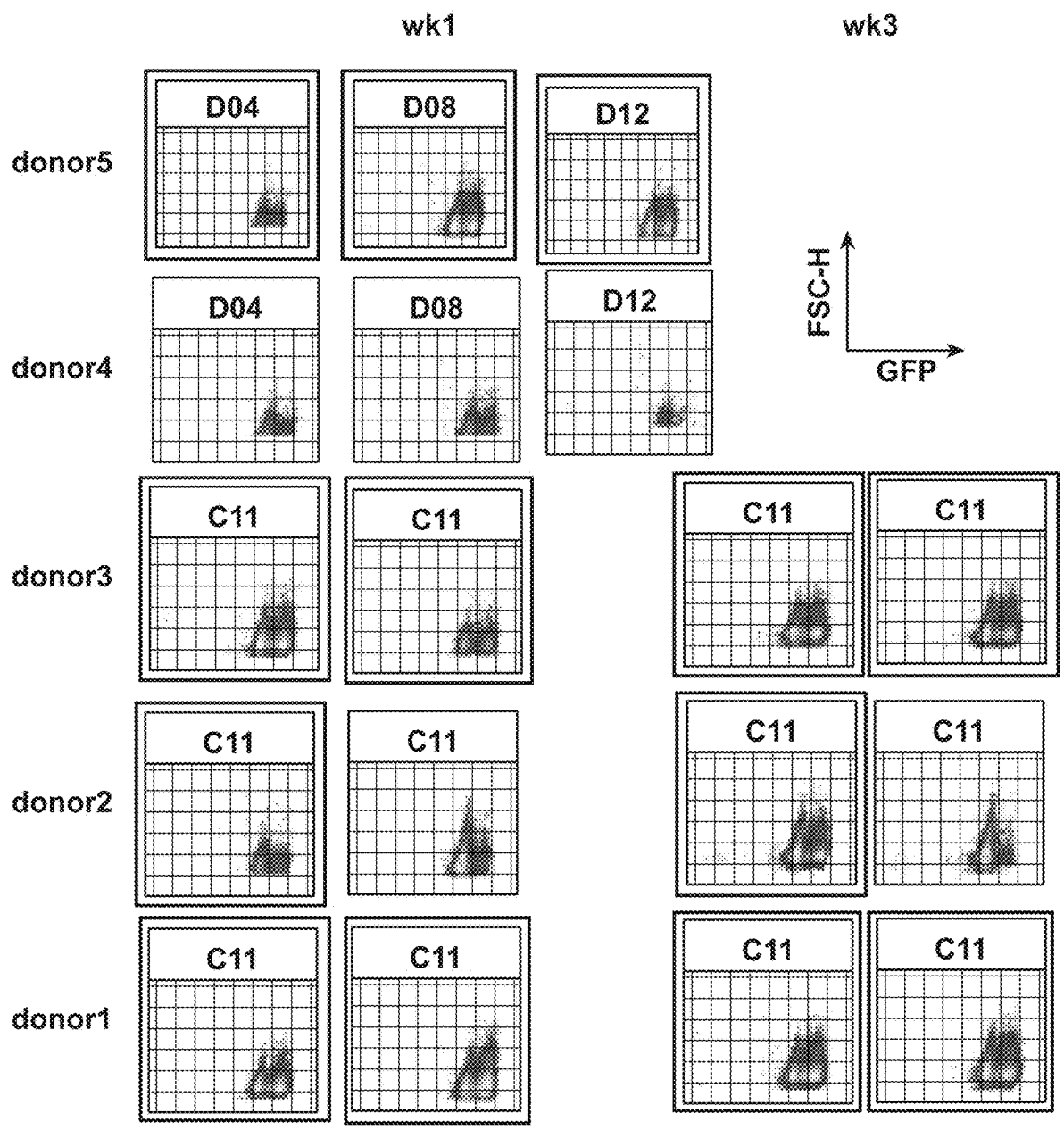
Figure 23:
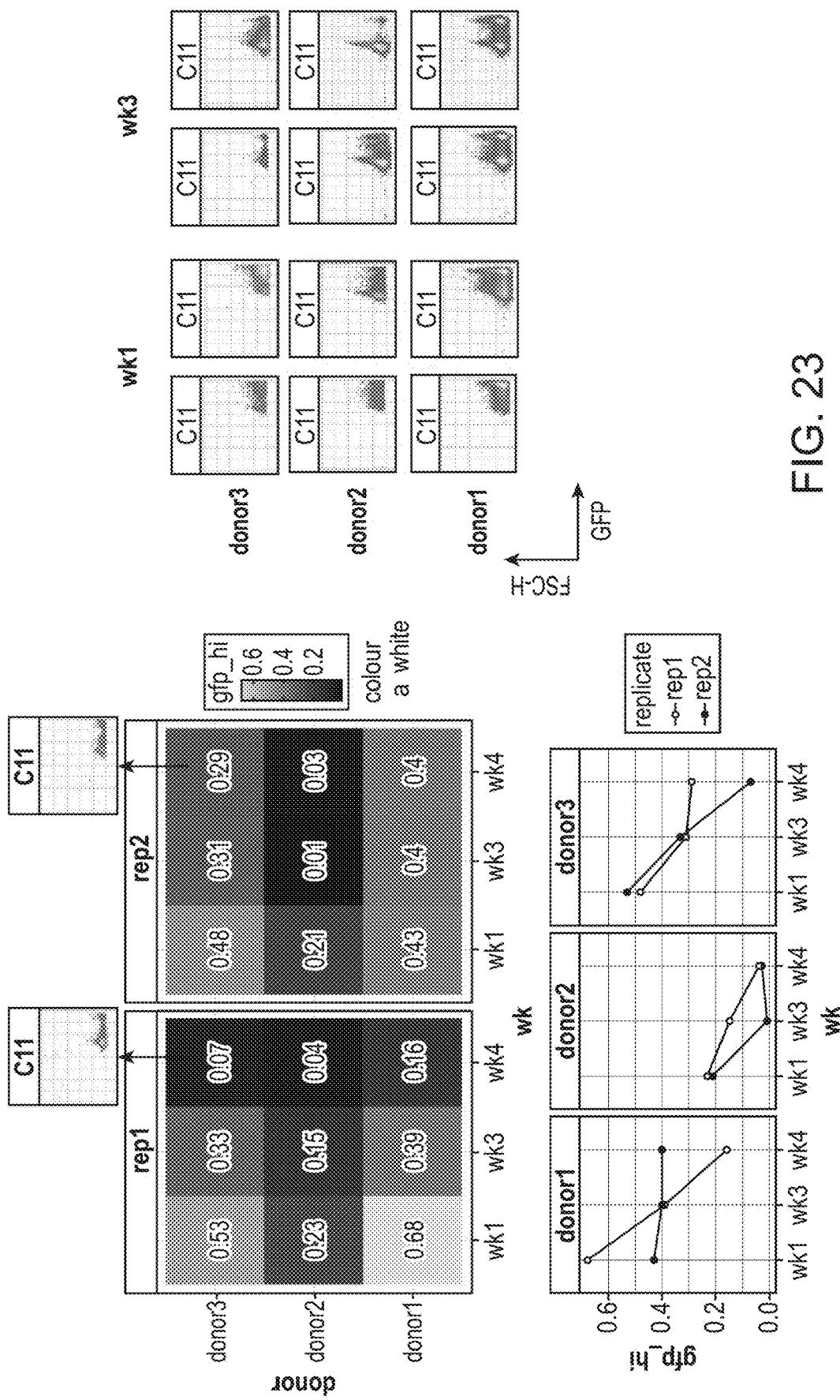
FIG. 23 includes plots showing the cell count and maximum GFP expression (GFP_high) readings when using sgRNA83, which targets a TRAC safe harbor locus, and the construct expression was driven by an exogenous promoter.
Figure 24:
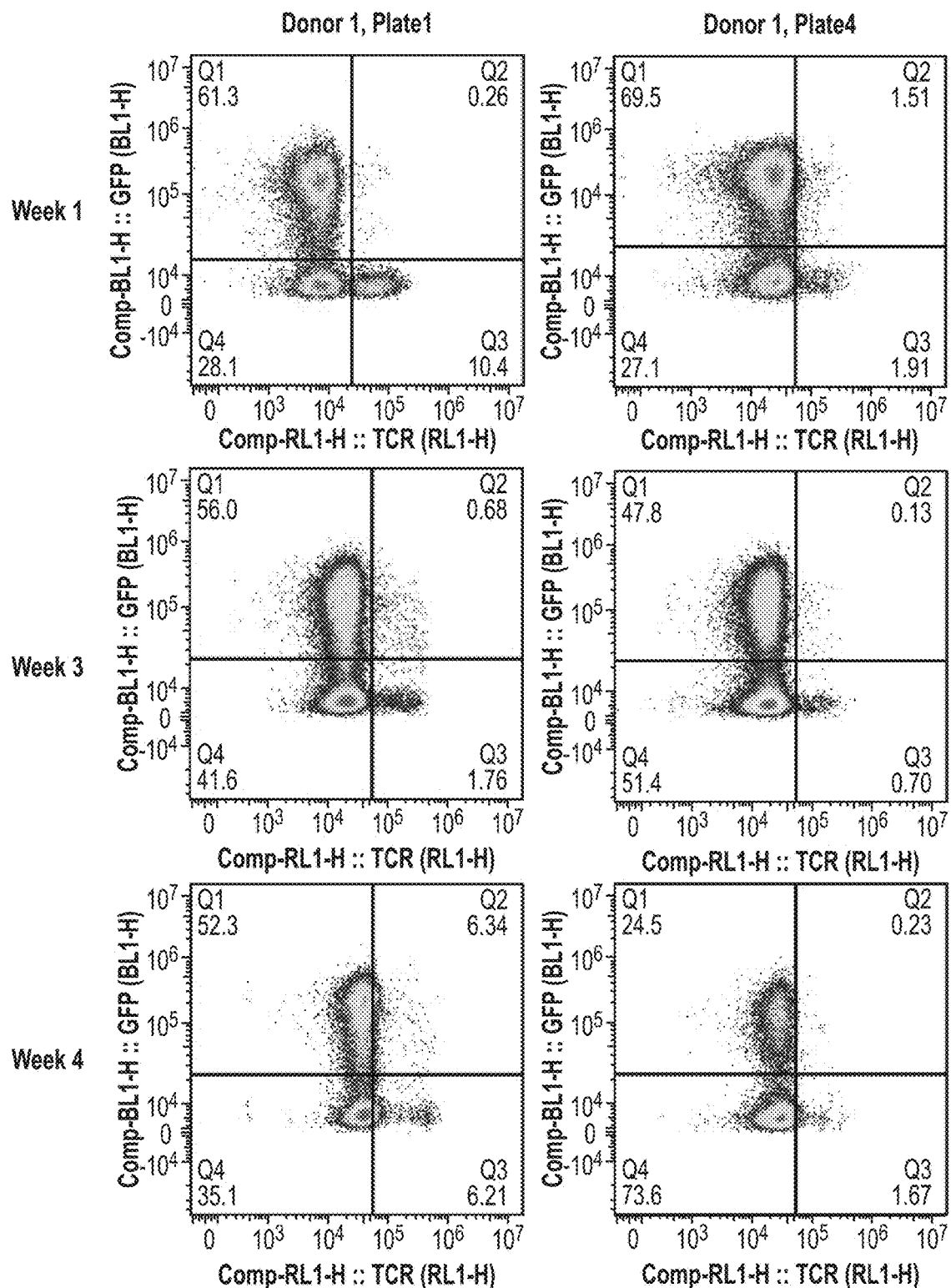
FIG. 24 includes plots showing TCR vs. GFP among all donors and time points when using sgRNA83 and the construct is driven by an endogenous promoter.
Figure 25:
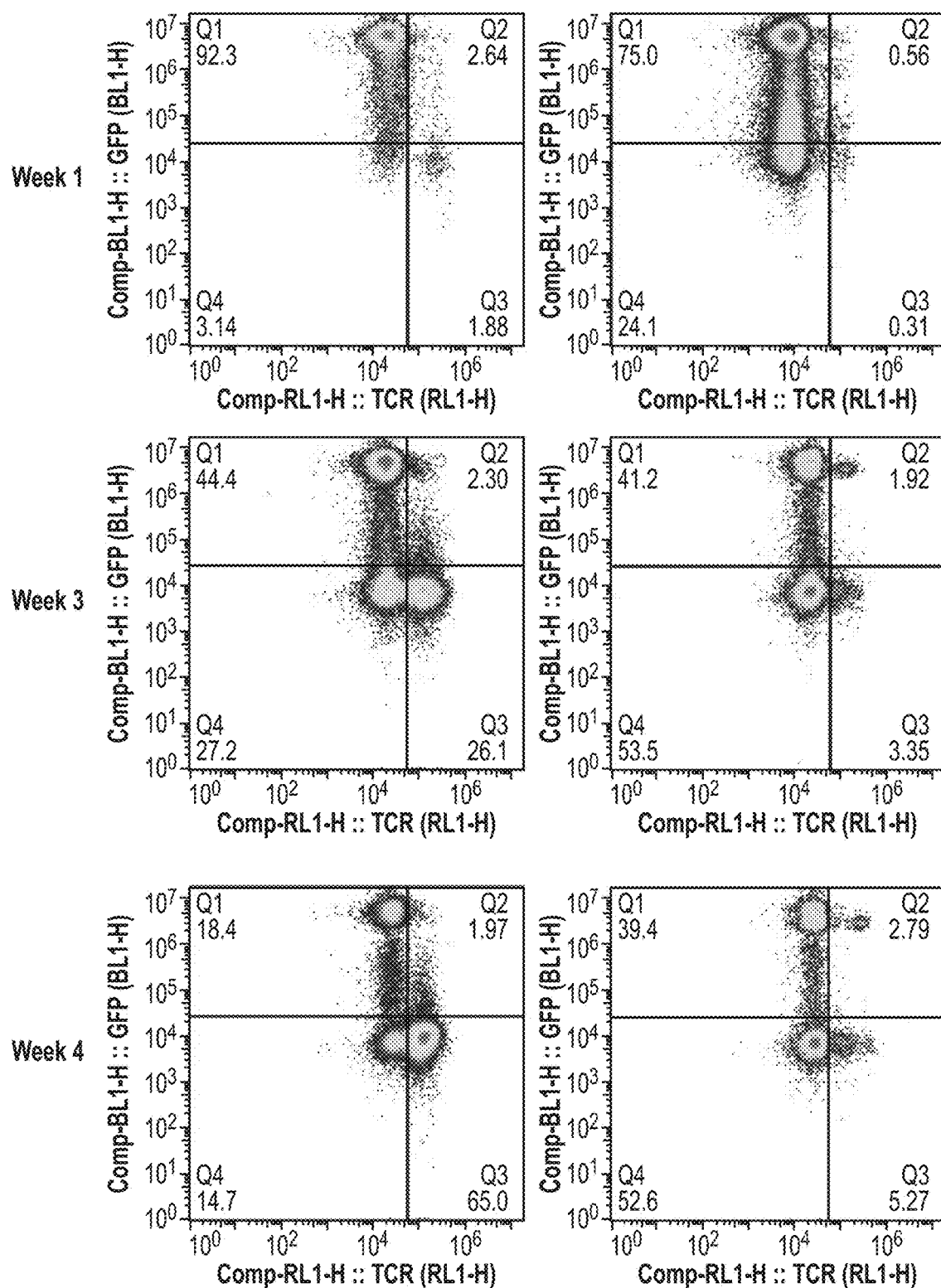
FIG. 25 includes plots showing TCR vs. GFP among all donors and time points when using sgRNA83 and the construct is driven by an exogenous promoter.
Figure 26:
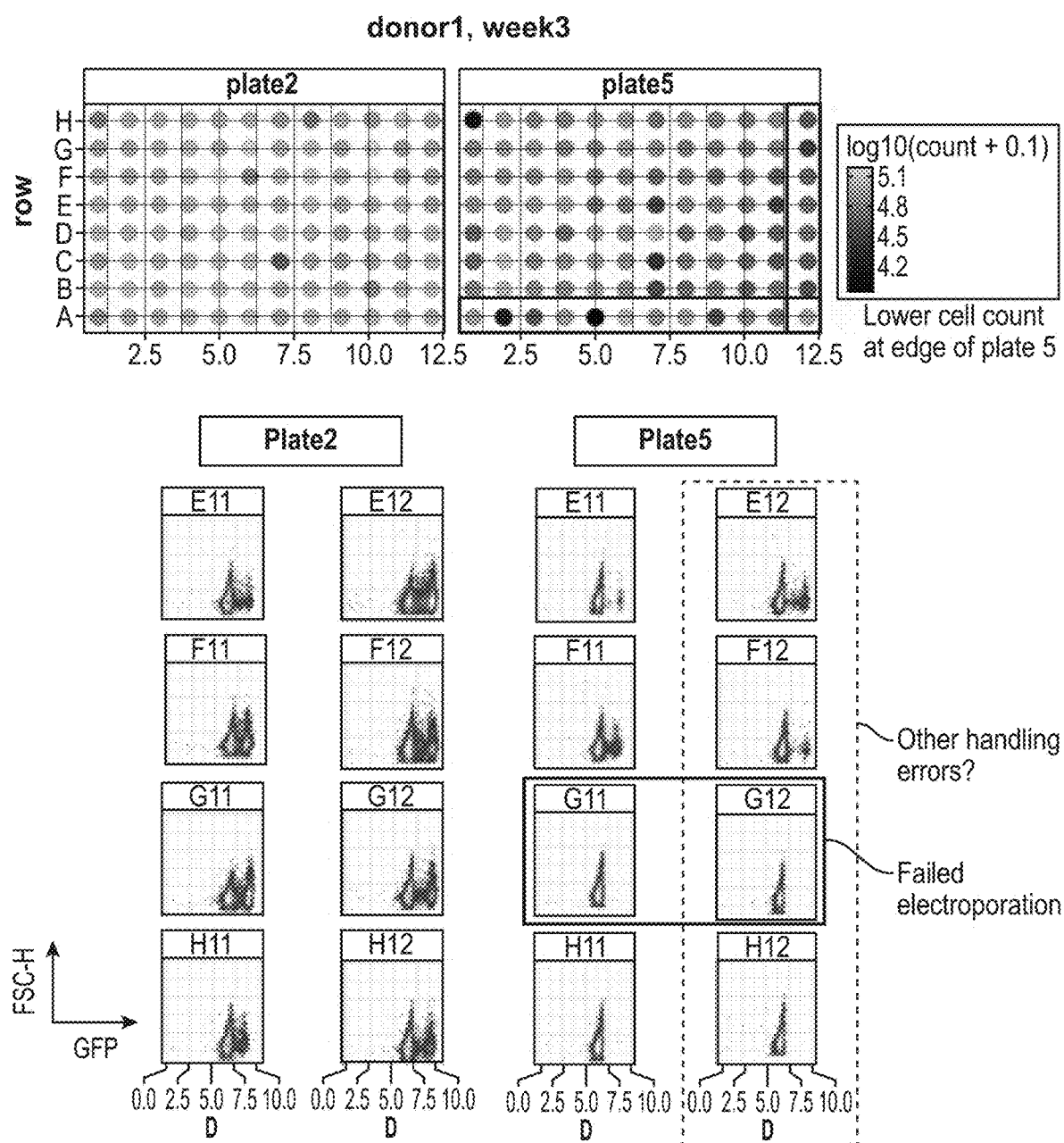
FIG. 26 includes plots illustrating potential sources of variation (e.g., edge effects and electroporation errors) observed between replicates and donors.
Figure 27:
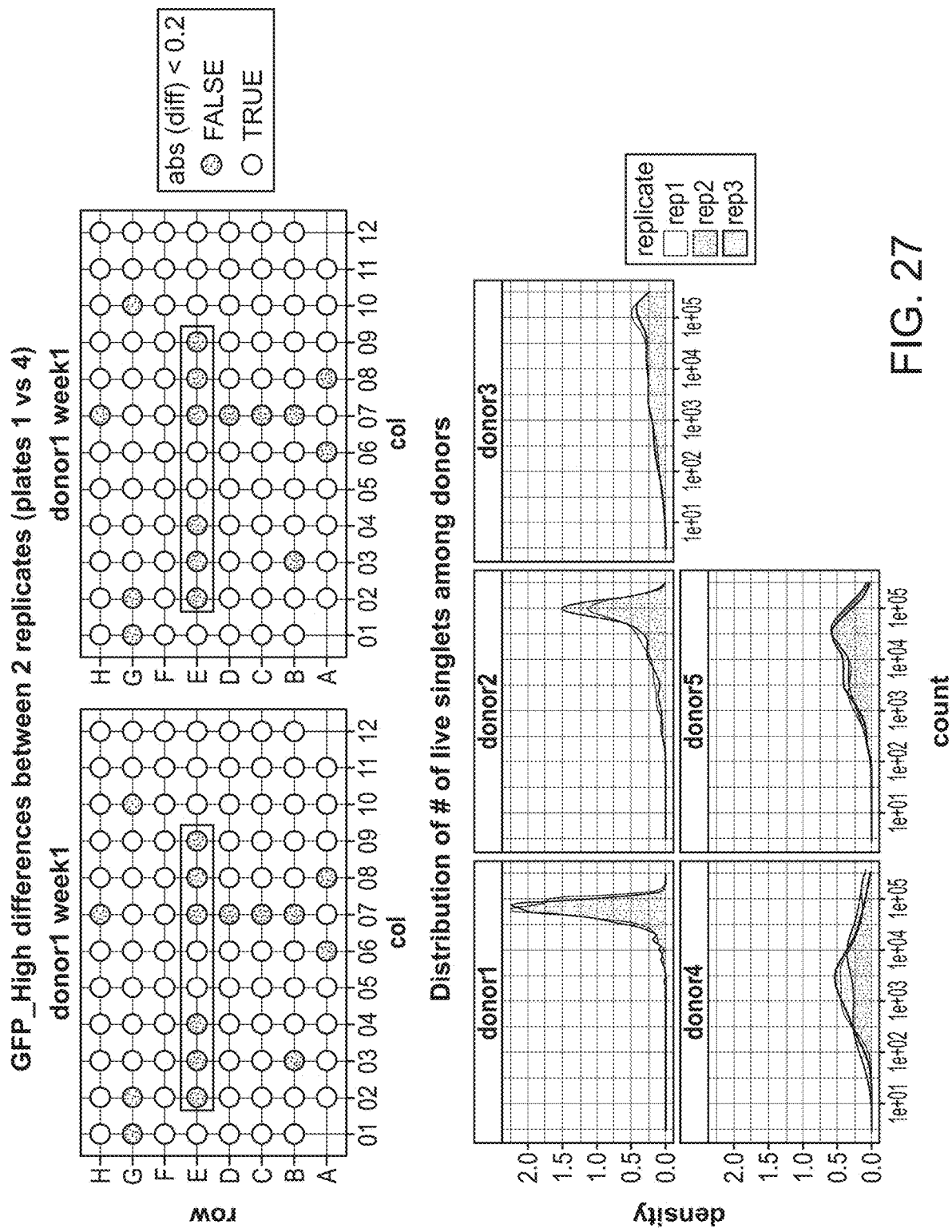
FIG. 27 includes plots illustrating potential sources of variation observed between replicates and donors, e.g., relating to inherent differences between donors.
Figure 28:
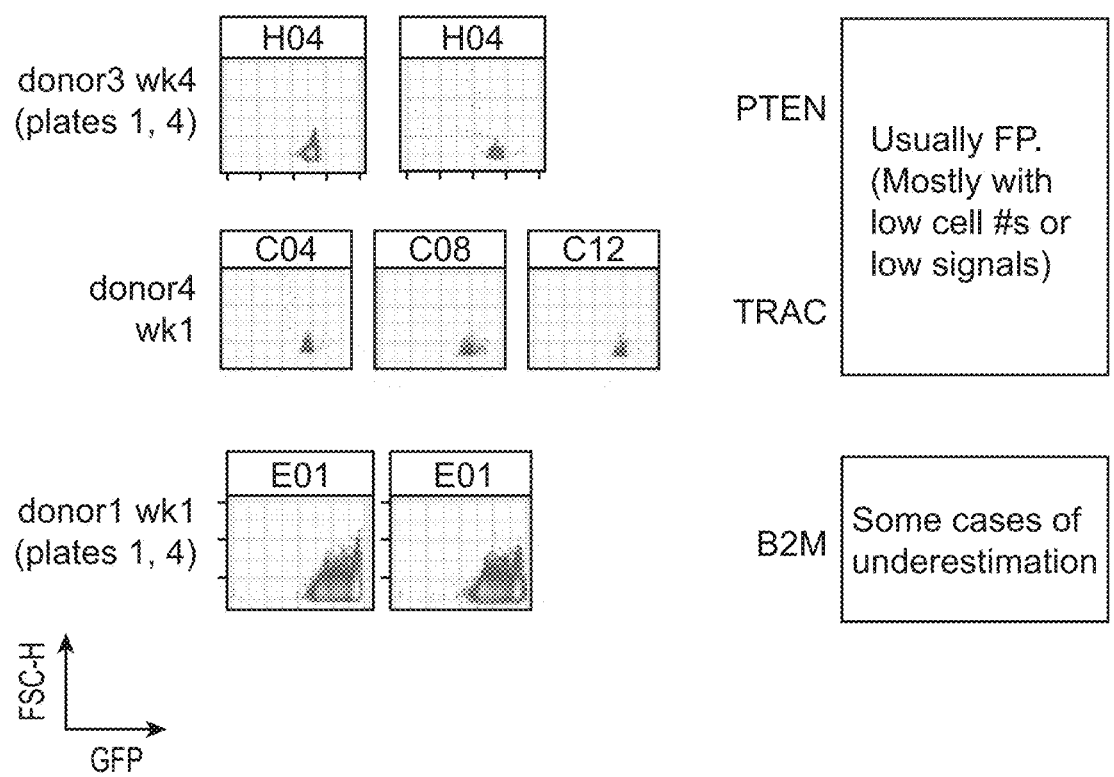
FIG. 28 includes plots illustrating potential sources of variation observed between replicates and donors, e.g., relating to gating errors.

A comparison of GFP expression trends between sgRNA79 and sgRNA83 for TRAC insertion and expression with an endogenous reporter revealed that donor 2 trends were different between sgRNA79 and sgRNA83, while donor 4 trends were the same (FIG. 18 and FIG. 22). Some potential reasons for the observed variation between replicates and donors include:

(1) manual handling of a large number of plates (e.g., FIG. 26):
Edge effects
Electroporation errors
(2) Inherent differences among donors (e.g., FIG. 27):
There were consistent differences with certain wells throughput the assay (spanning multiple weeks)
There were variable cell numbers between donors
(3) Gating errors (e.g. FIG. 28):
1 peak vs >2 peaks in GFP signals Example 4: Ranking Loci by Expression and KI Efficiency The loci were ranked based on mean florescence intensity (MFI) of reporter gene, GFP, and KI efficiency.

Figure 29:
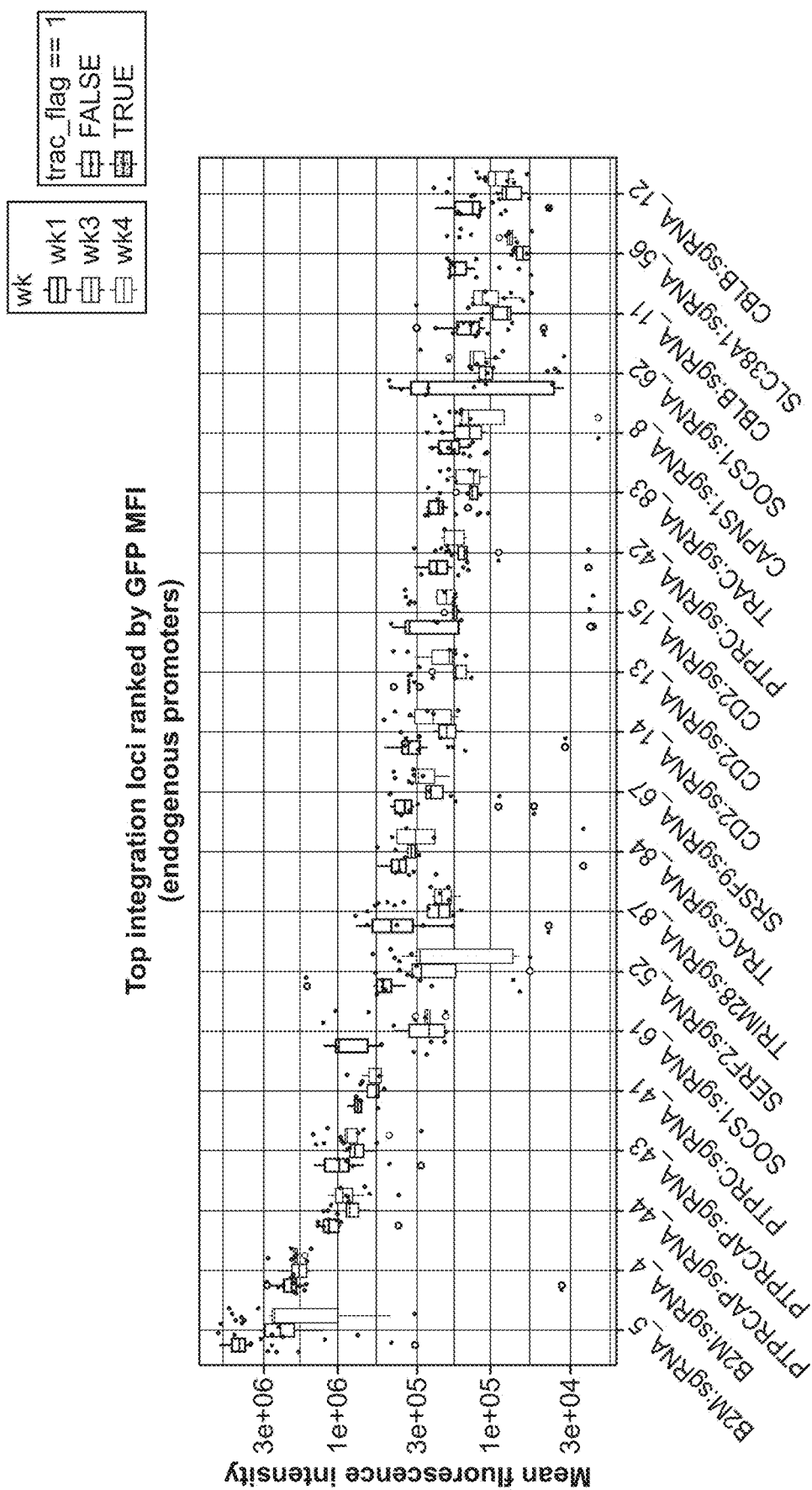
FIG. 29 includes plots showing the GFP mean fluorescence intensity (GFP MFI) and KI efficiency for top KI loci evaluated with endogenous promoters.
Figure 29:
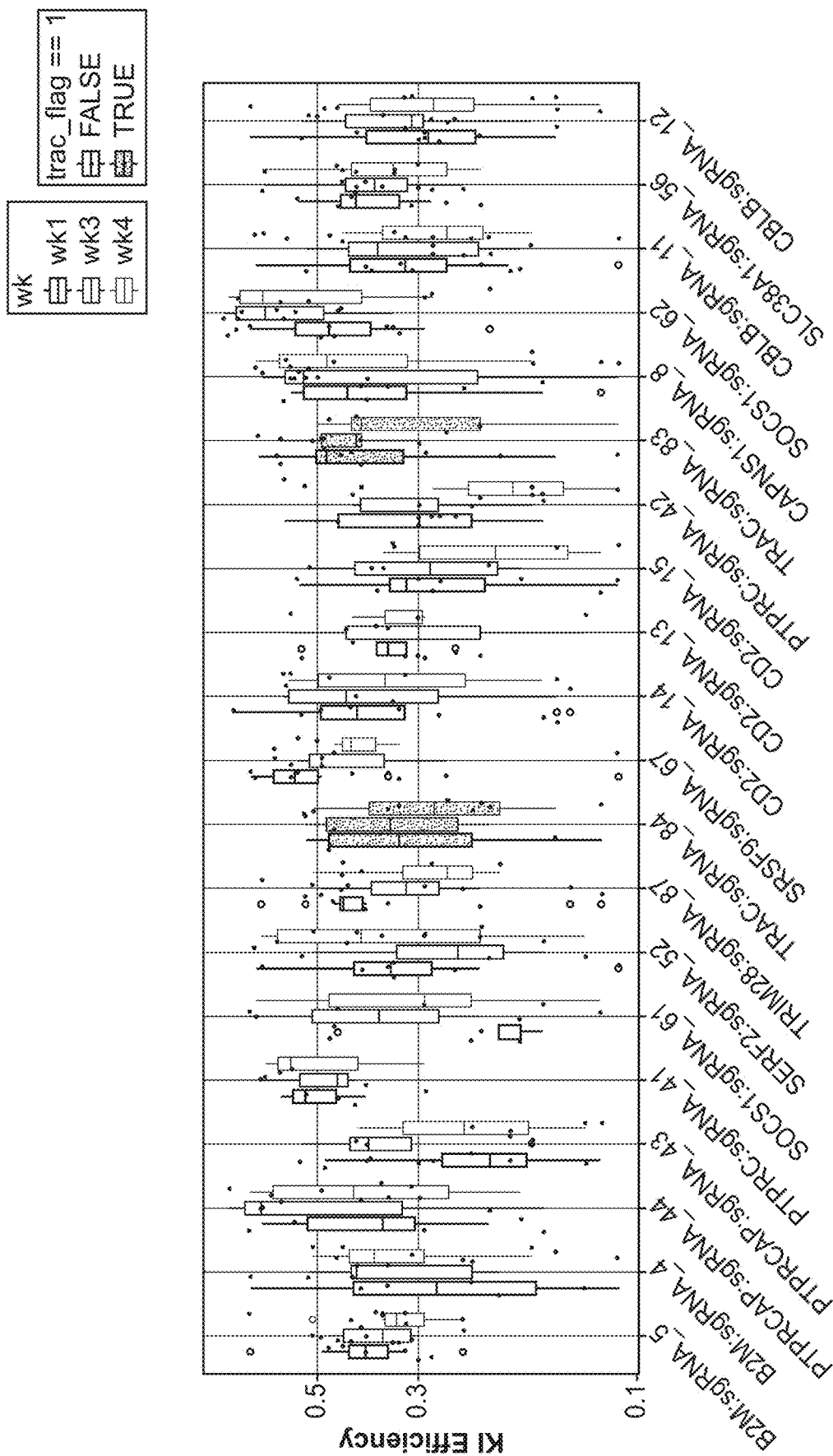

FIG. 29 shows GFP MFI and KI efficiency for all significant loci having endogenous promoters. The B2M locus reported the highest GFP MFI. The TRAC locus was among the top 10 MFI. The highest GFP MFI readings were reported in week 1 and reduced slightly in weeks 3 and 4. The results also showed most top loci have more than 1 sgRNA. With regard to KI efficiency, the SOCS1 locus reported the highest KI efficiency. Overall, KI efficiency showed greater variation among donors than GFP MFI.

Figure 30:
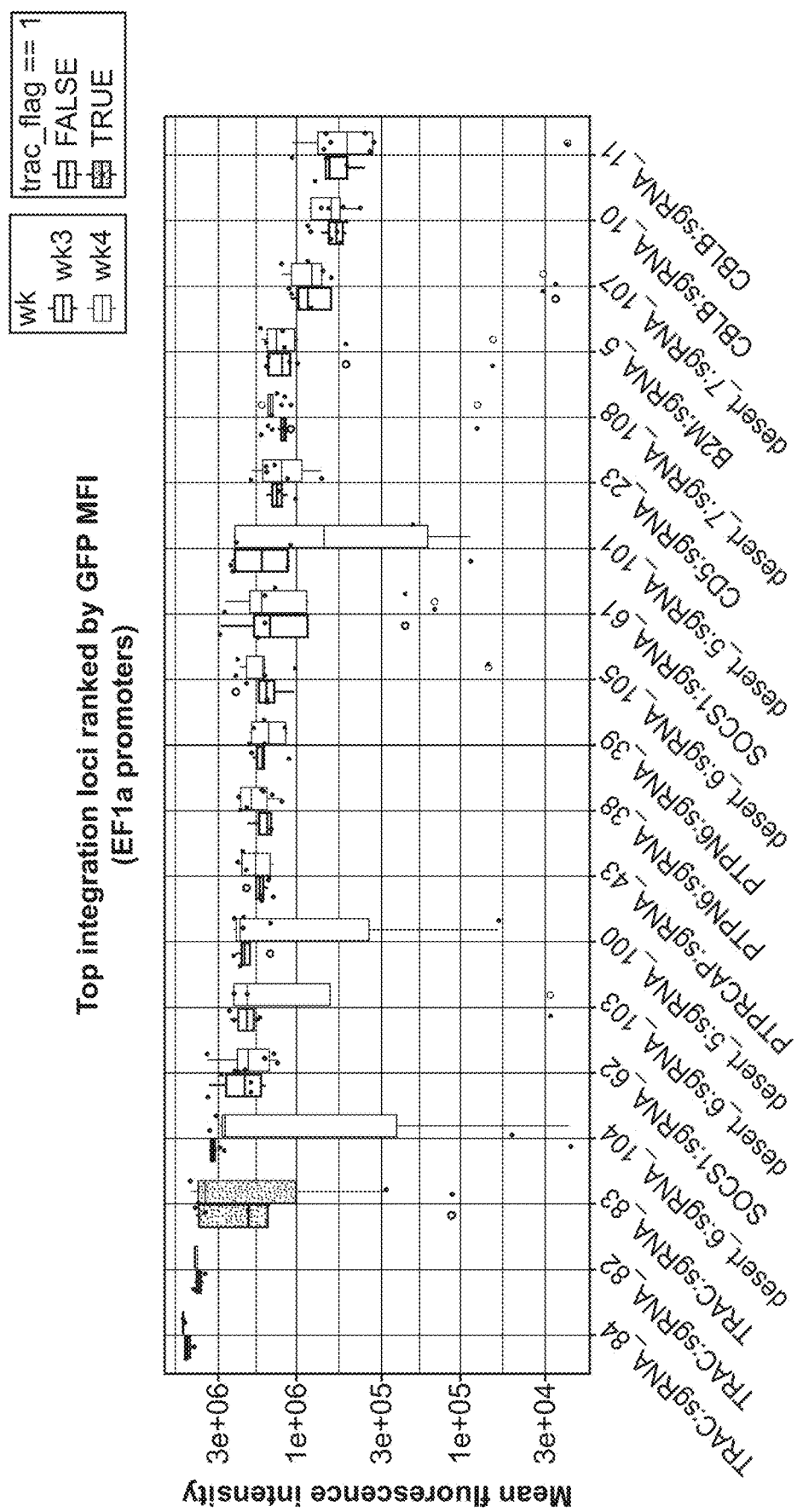
FIG. 30 includes plots showing the GFP mean fluorescence intensity (GFP MFI) and KI efficiency for top KI loci evaluated with the EF1a promoter.
Figure 30:
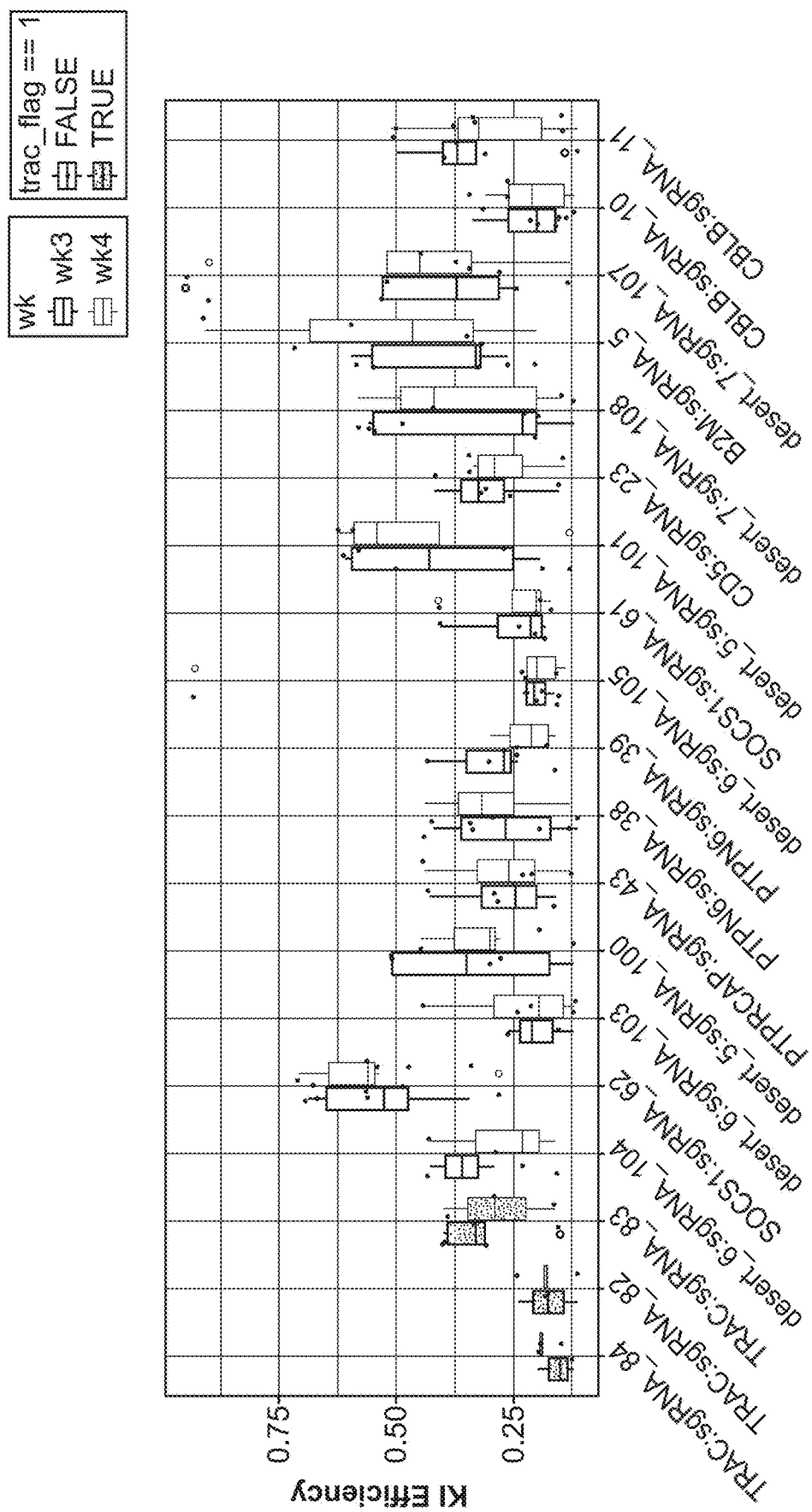

FIG. 30 shows GFP MFI and KI efficiency for all significant loci having exogenous promoters (e.g. EF1a promoters). The TRAC locus reported the highest GFP MFI. There was comparable expression between weeks 3 and 4. The results also showed most top loci have more than 1 sgRNA. With regard to KI efficiency, the SOCS1 locus reported the highest KI efficiency. Overall, KI efficiency showed less variation when driven by the exogenous promoters than when driven by endogenous promoters.

Figure 31A:
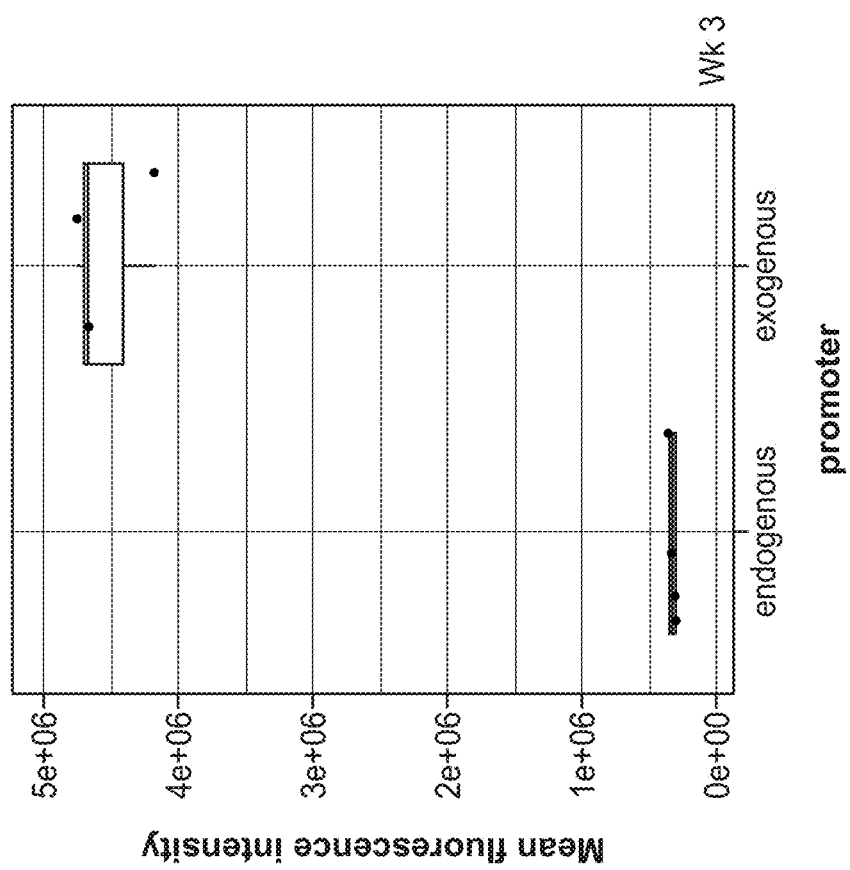
FIGS. 31A-31C include plots showing all the significant KI loci (top KI loci) as evaluated with endogenous and EF1a promoters.
Figure 31B:
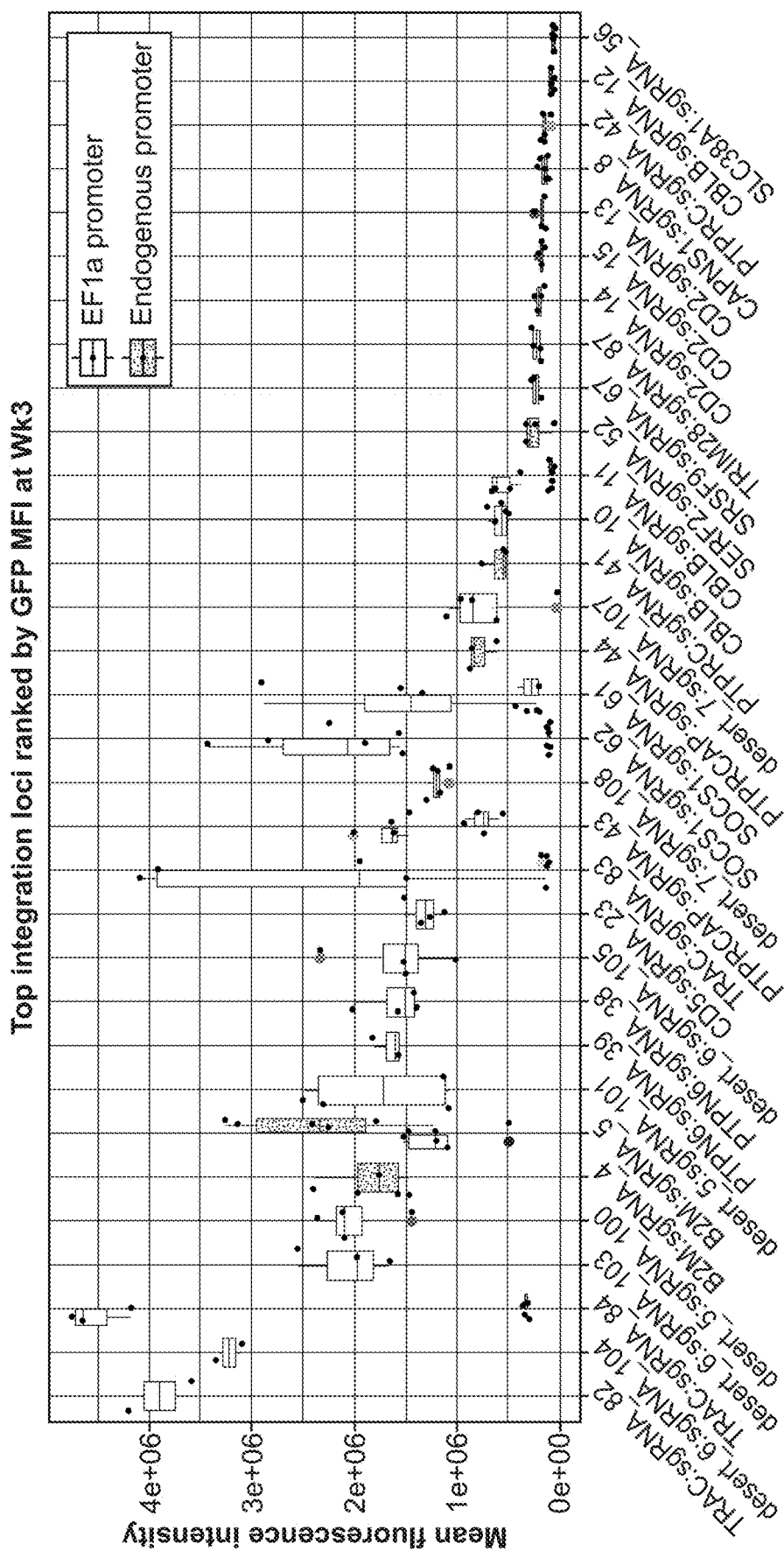
Figure 31B:
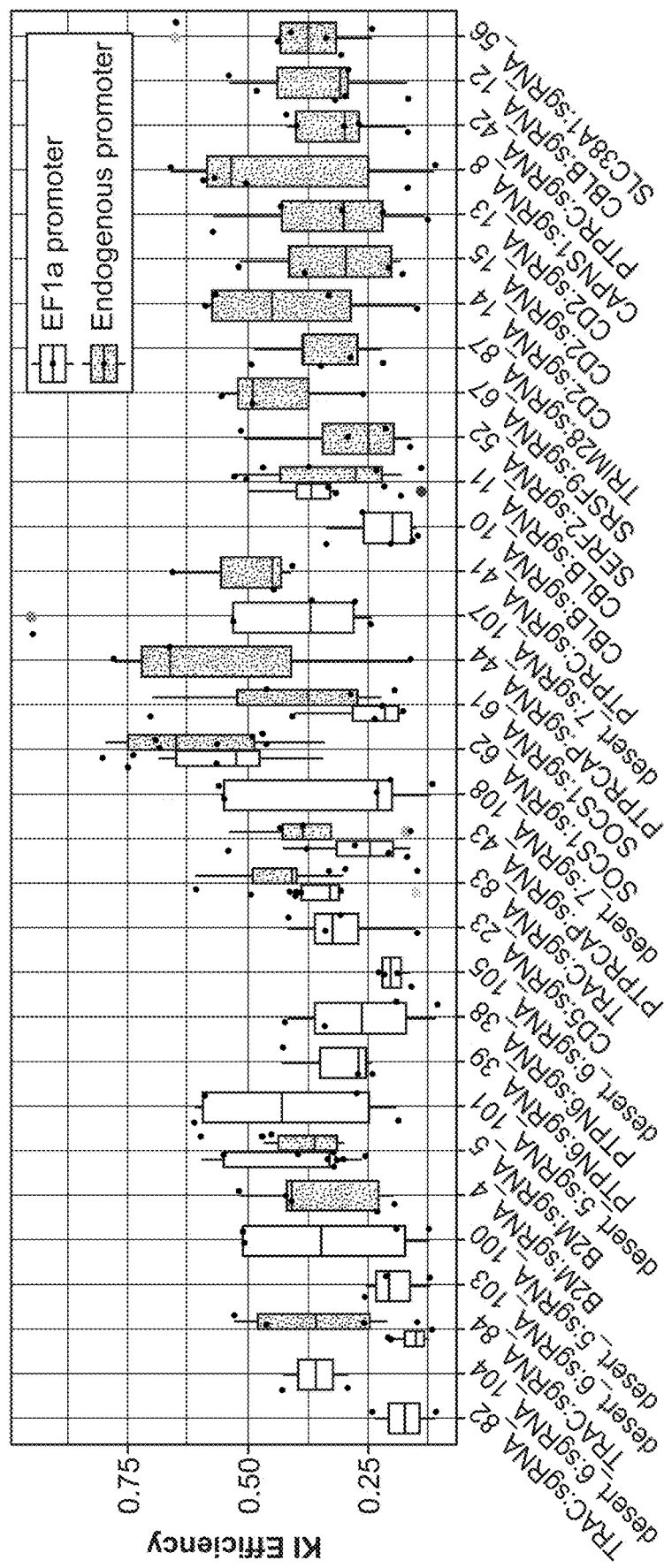
Figure 31C:
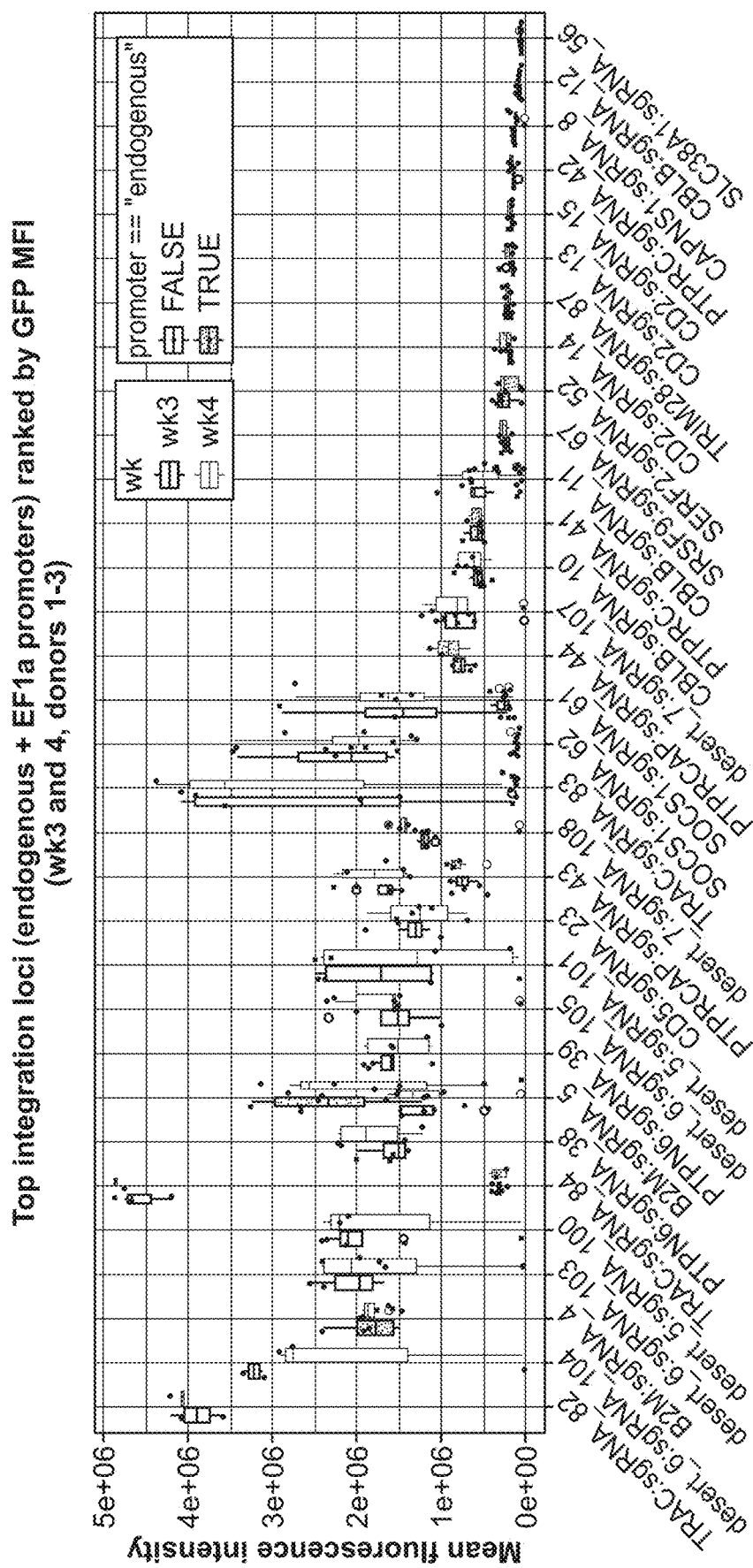
Figure 31C:
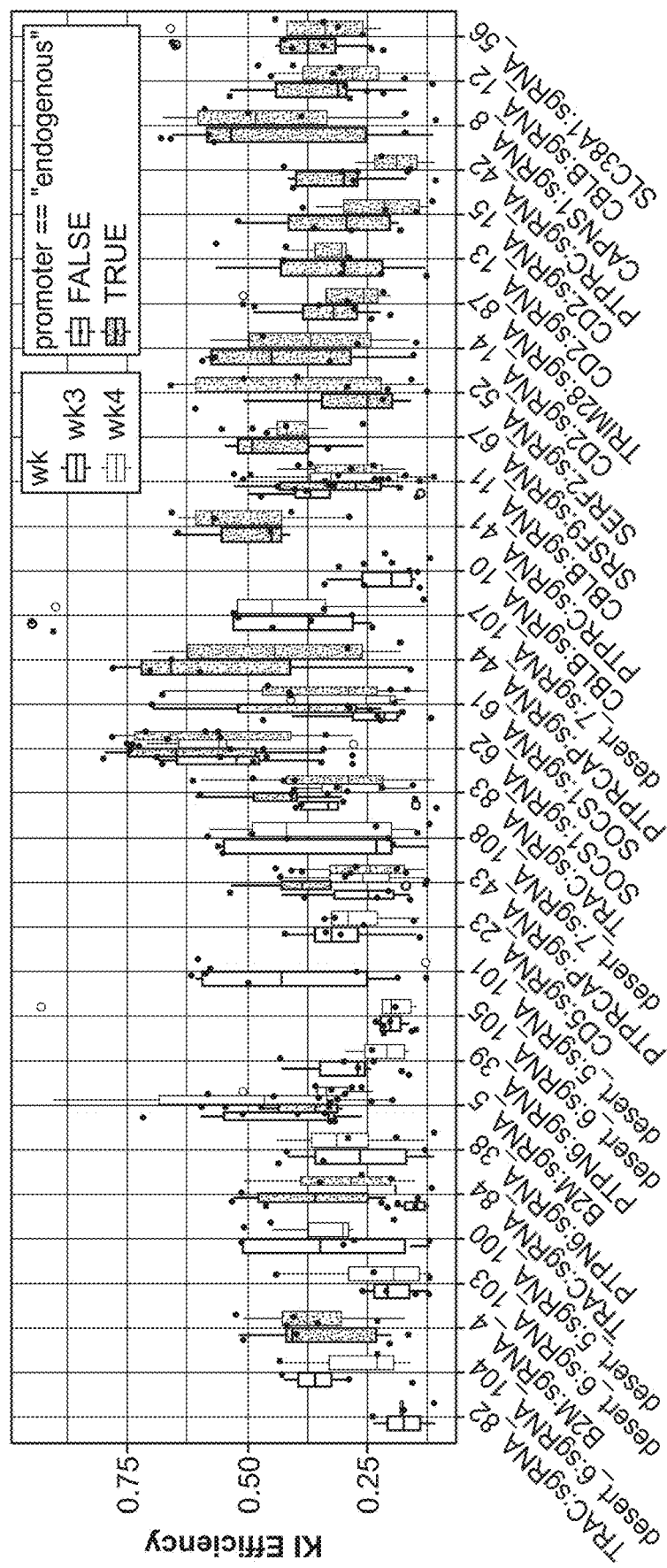

FIGS. 31A, 31B, and 31C show GFP MFI and KI efficiency for all significant loci having endogenous and exogenous (e.g., EF1a) promoters. The results showed that expression driven by EF1a promoters is about 10× higher than endogenous promoters (FIG. 31A). With regard to KI efficiency, the SOCS1 locus reported the highest KI efficiency. At weeks 3 and 4, KI efficiency was higher when driven by the exogenous promoters than when driven by endogenous promoters.

Example 5: Evaluation of TCR Expression in Candidate Noncoding Sites

Figure 32A:
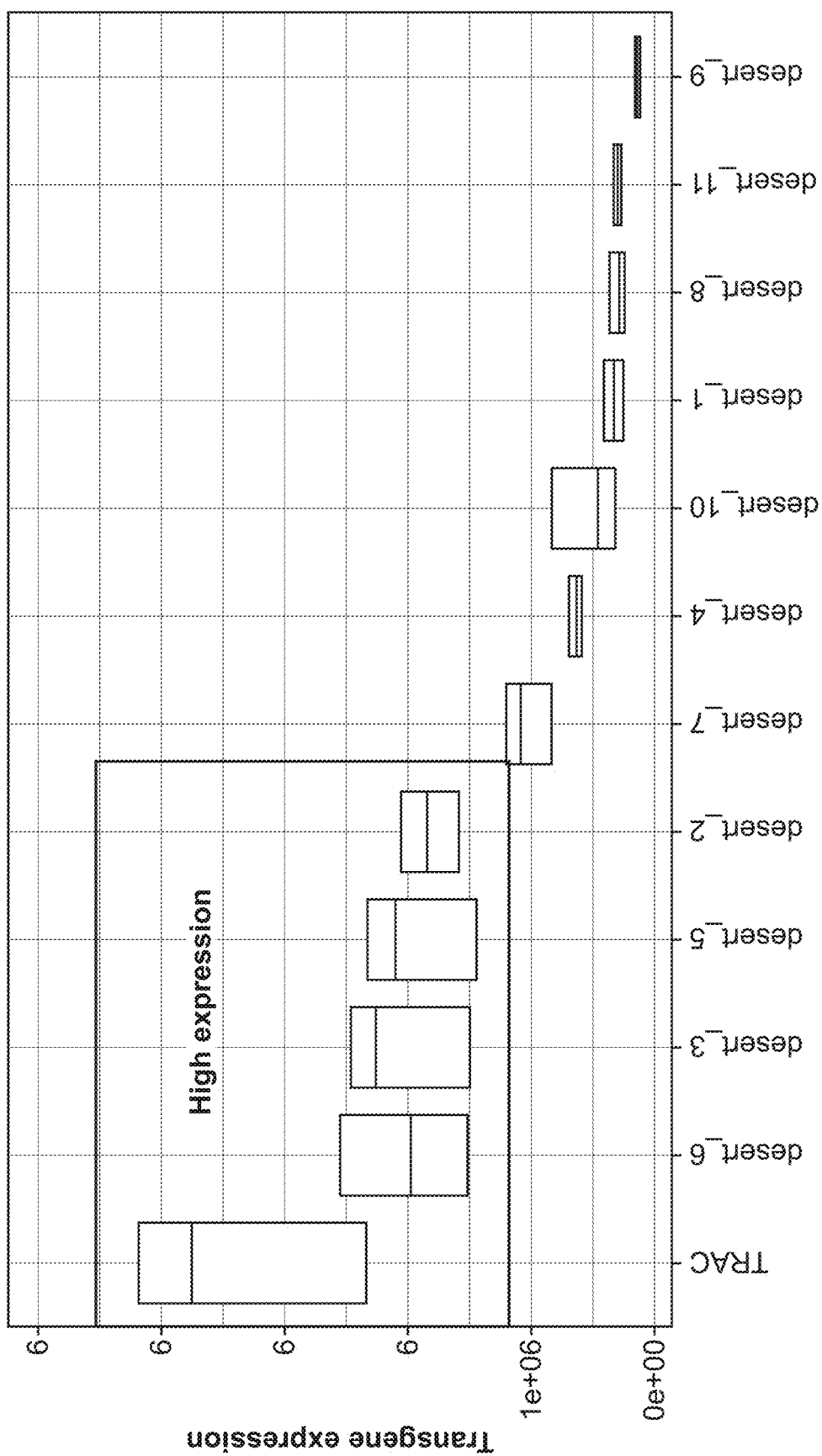
FIG. 32A includes a plot showing some target loci and their measured transgene expression levels.

This experiment was conducted to identify target loci and integration sites that enable high transgene expression without disrupting the TCR. Some gene deserts (e.g. gene deserts 2, 3, 5, and 6) were identified as having high transgene expression (FIG. 32A).

Figure 32B:
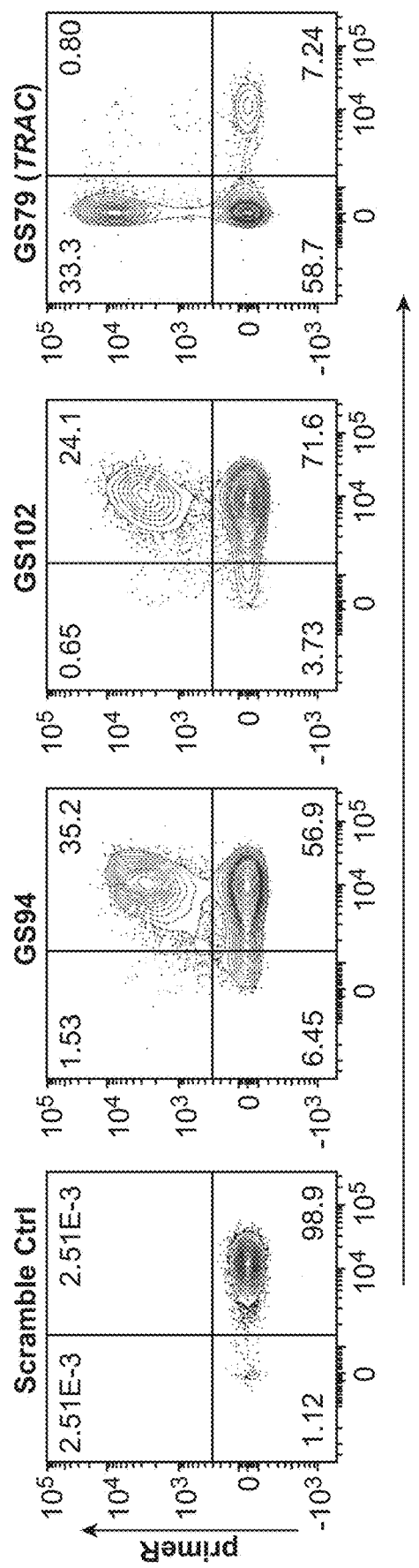
FIG. 32B includes plots showing the transgene (Prime Receptor (PrimeR)) and TCR expression for the control and insertion at GS94, GS102 and TRAC loci.
Figure 33A:
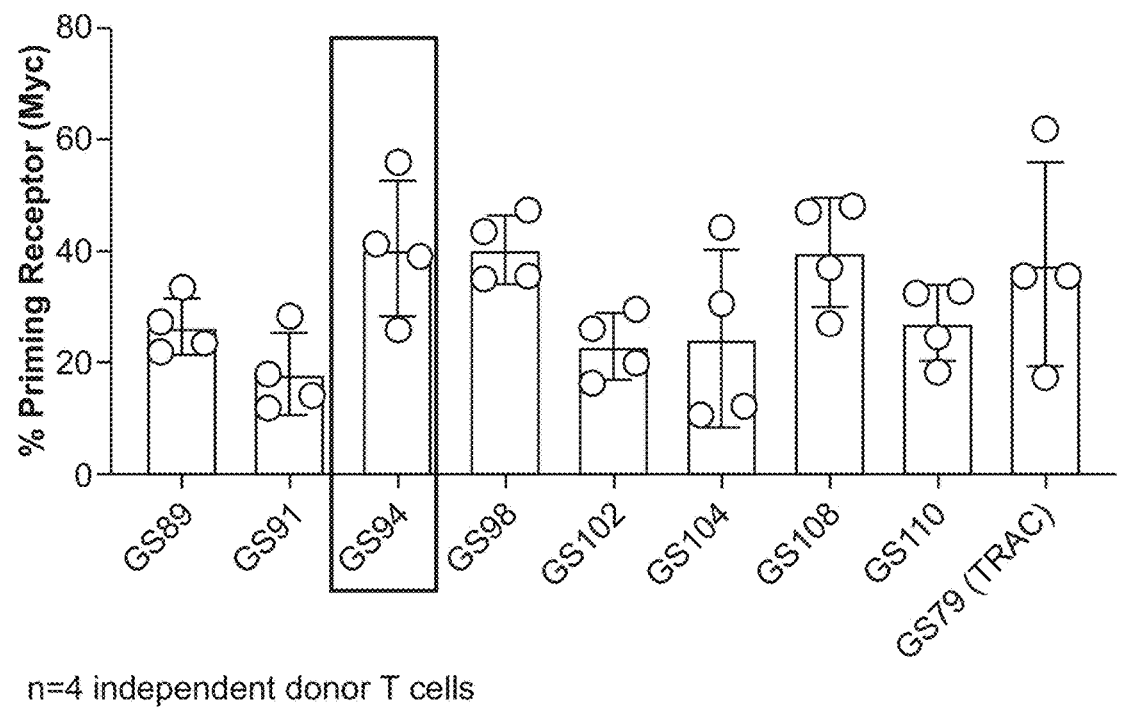
FIG. 33A includes a plot showing the PrimeR levels measured for the indicated integration sites.

To evaluate and identify preferred knock-in sites, TCR expression was measured following circuit cassette knock in of PrimeR (Prime Receptor (Myc)). Myc denotes an N-terminal Myc epitope tag to facilate detection of surface expressed primer receptor. Briefly, CD3-CD28 Dynabead-activated T cells were electroporated with sgRNA/Cas9 RNPs targeting the indicated sites (see FIGS. 32B and 33A), as well as HDRTs with homology arms directing HDR-mediated integration into the indicated sites. At day 6 post-electroporation, cells were stained with anti-TCRalpha/beta and anti-myc antibodies and analyzed on an Attune NxT flow cytometer. As shown in FIG. 32B, the TCR expression was maintained at GS94 and GS102 candidate integration (knock-in) sites. Only ⅔ of the cells that had circuit cassette knock in of PrimeR at GS79 (TRAC) locus maintained TCR expression. These results indicated that the GS94 and GS102 sites showed better potential for TCR stimulation.

The percentage of cells showing effective knock-in (based on measurements of PrimeR) was 36%±4% when using the GS94 integration site, as compared to 32%±5% when using the TRAC integration site. These results revealed integration sites, including GS94, that supported reproducibly high circuit cassette knockin rates. See FIG. 33A.

Example 6: Evaluation of GS94 Circuit Expression and Function

Figure 33B:
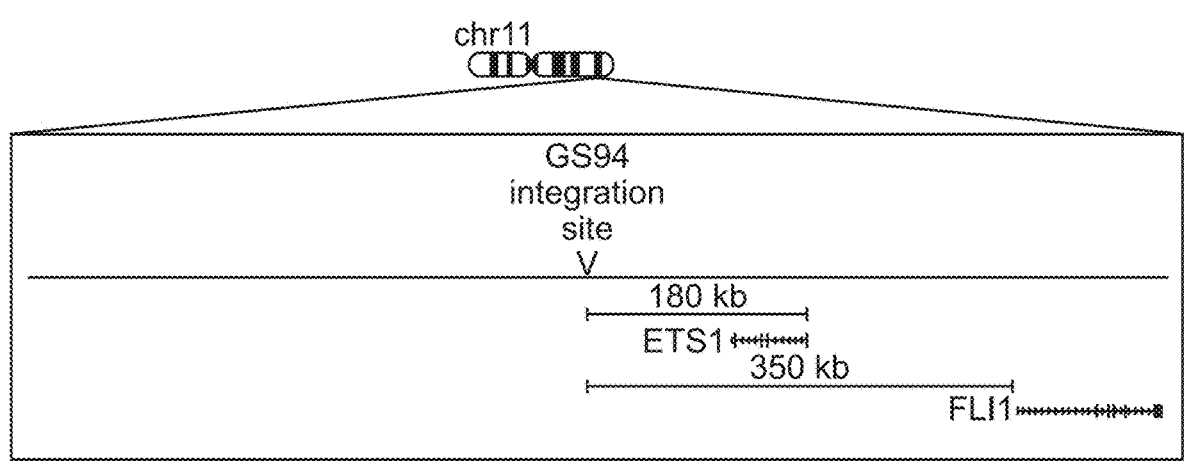
FIG. 33B includes a schematic showing the GS94 integration site on Chromosome 11.

GS94 is a candidate integration site located on chromosome 11's distal q arm. It is within 180-350 kb of the promoters for ETS1 and FLI1 (FIG. 33B), however that is considered low-risk for integration vector gene therapy. The circuit expression and function potential of the GS94 gene was evaluated.

T cells underwent circuit cassette integration with PrimeR at GS79 (TRAC) integration site and GS94 integration site. The cells were cocultured with K562 C19 cells for 48 hours and then the PrimeR induced CAR MFI was compared to the PrimeR MFI.

Figure 34A:
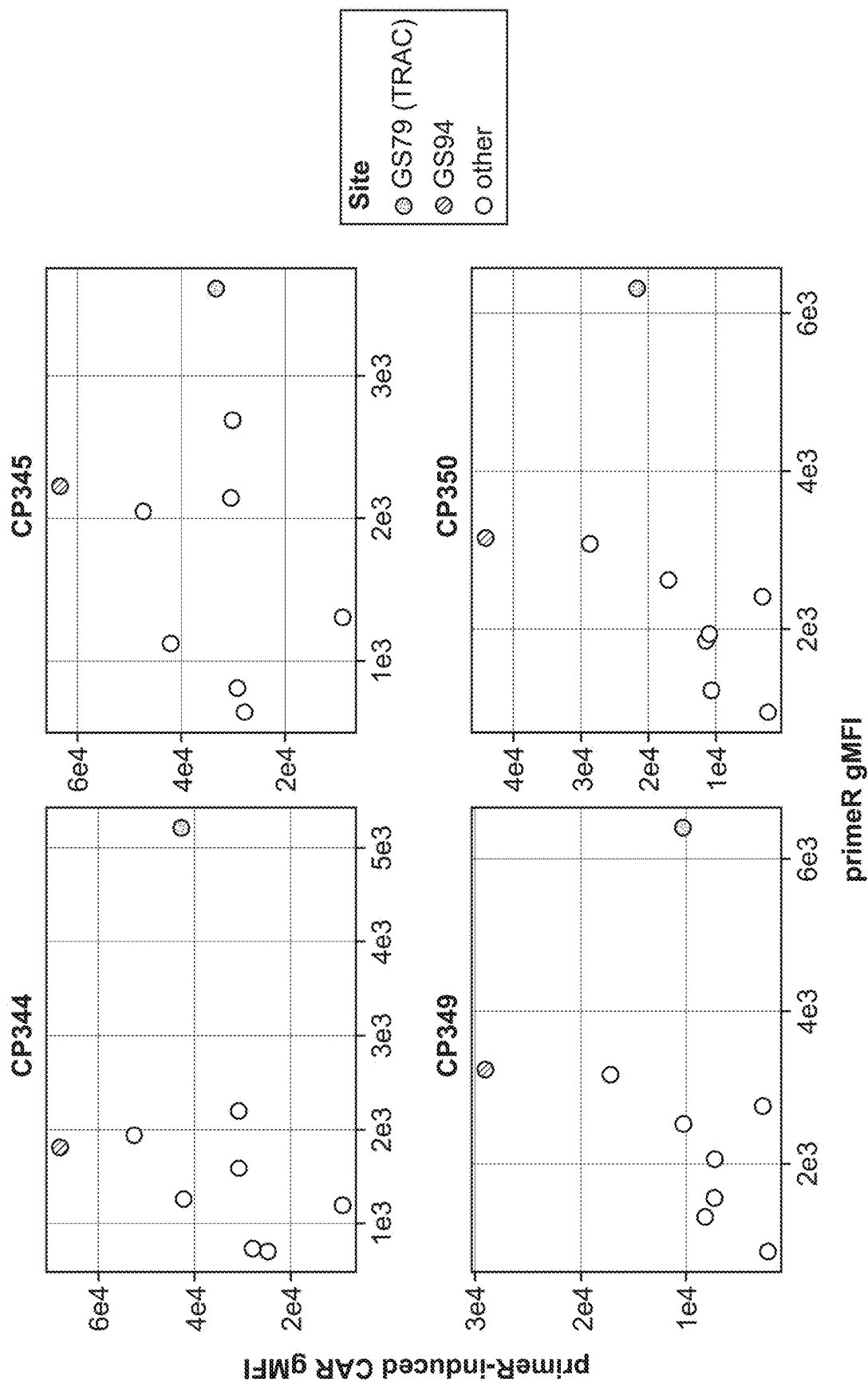
FIG. 34A includes plots showing CAR induction and primeR expression of engineered T cells after 48 hours of coculturing with K562-CD19 cells.

Briefly, T cells generated as described in the Example above were cocultured with K562 CD19+/MSLN− cells at day 7 post-electroporation. MSLN (mesothelin) is a gene that is overexpressed in human pancreatic cancer. Cells were then stained with anti-FLAG antibody 48 h post initiation of coculture and analyzed on an Attune NxT flow cytometer. The results revealed that GS94 yields superior CAR induction with high prime R expression following the 48-hour coculture with the K562 C19 cells. See FIG. 34A. GS94 resulted in prime antigen-dependent CAR expression that was approximately two-fold higher than the expression in several other candidate integration sites as well as the TRAC integration site. Additionally, on average, the prime receptor surface expression level was no less than 50% of expression level when using the TRAC integration site.

Cytotoxicity and Cytokine Secretion

Figure 34B:
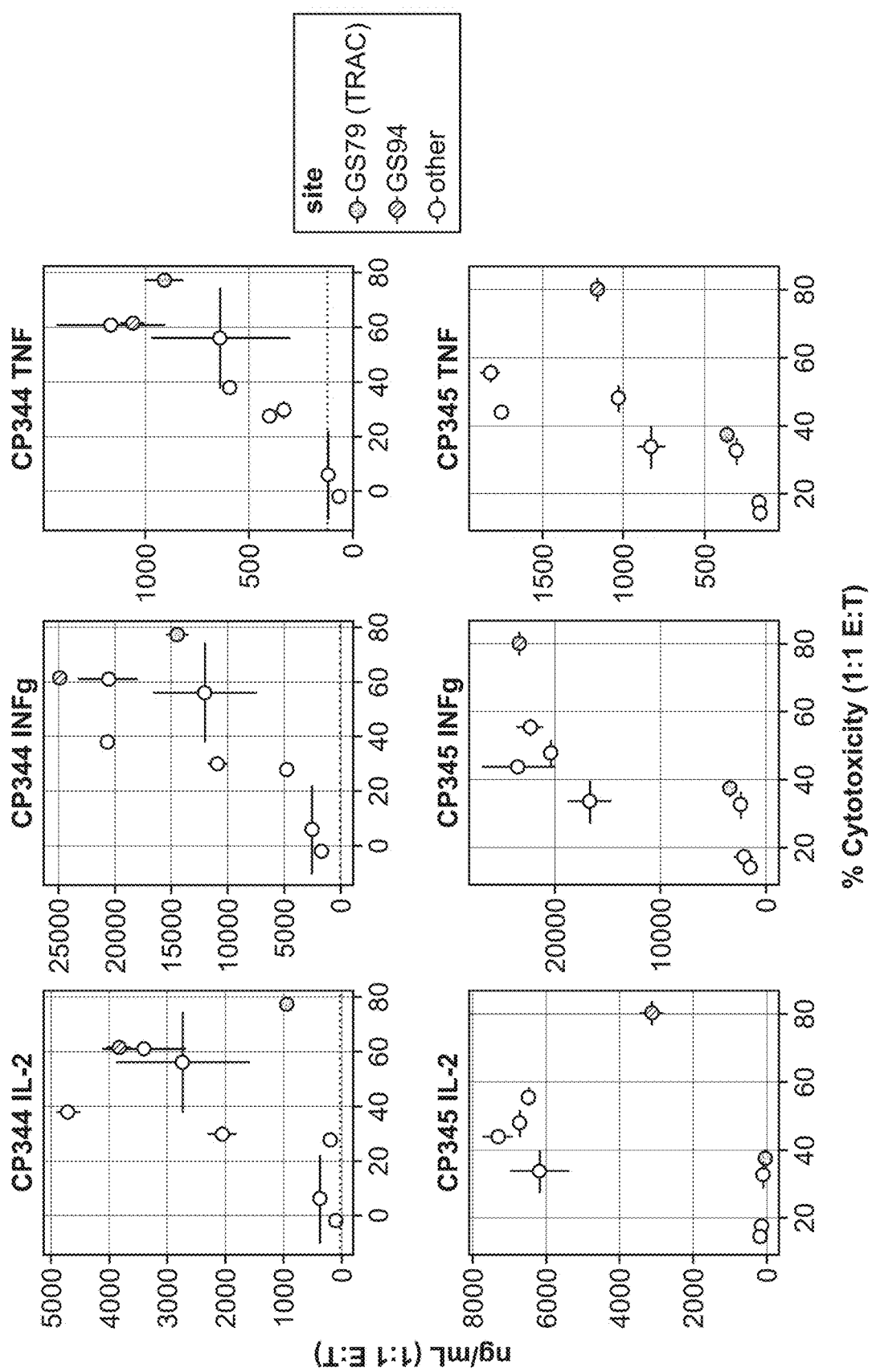
FIG. 34B includes plots showing the cytotoxity and cytokine secretion levels for engineered T cells 48 hours of coculturing with K562-CD19/MSLN cells.

To evaluate the effect of the candidate integration site on cytotoxicity and cytokine secretion, T cells that had undergone circuit cassette integration with PrimeR at GS79 (TRAC) integration site and GS94 integration site were cocultured with K562 C19/MSLN cells for 48 hours. MSLN is a gene that is overexpressed in human pancreatic cancer. The cells were treated at a 1:1 effector:target cell ratio (1:1 E:T)). Briefly, T cells generated as described above were cocultured with K562 CD19+/MSLN+ cells at day 7 post-electroporation. 48 h post initiation of coculture, supernatants were collected and analyzed via Luminex for cytokine levels. The cytokines measure were IL-2, INFg, and TNF. Cytotoxicity was analyzed by measuring luciferase activity of remaining target cells after 48 h. Each of the data points in FIG. 34B represent two replicates and the lines represent the range of cytotoxicity for the replicates. As shown in FIG. 34B, the GS94 integration sites resulted in superior cycotoxic ability and cytokine secretion following the 48-hour coculture with K562 C19/MSLN cells.

Prime-Independent Cytotoxicity

Figure 35B:
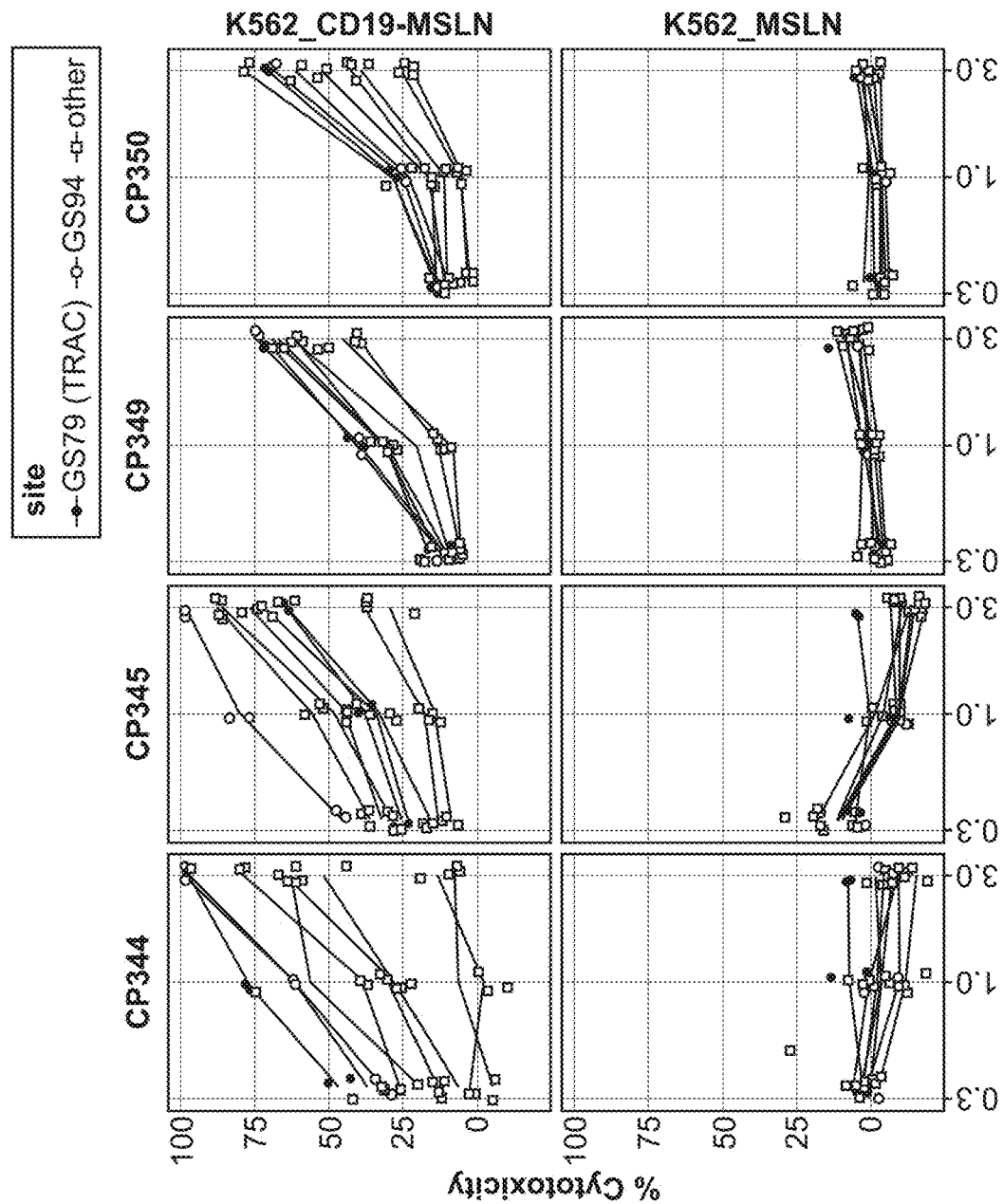
FIG. 35B includes plots showing the measured cytotoxicity for engineerred T cells cocultured for 48 hours with the K562 CD19+/MSLN+ or K562 CD19−/MSLN+ cells.
Figure 35A:
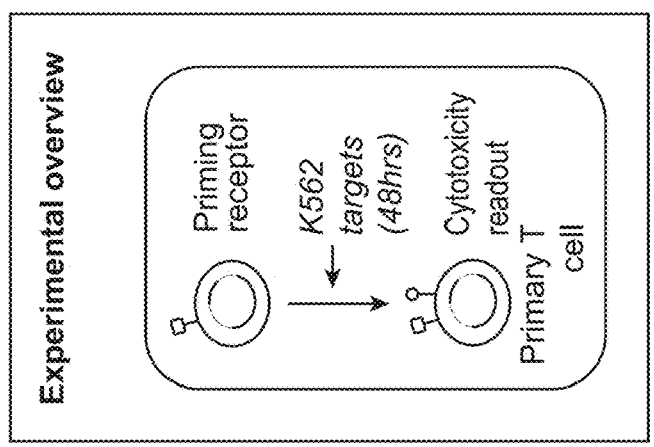
FIG. 35A includes a schematic showing the experimental overview for evaluating the effect of integration site on cytotoxicity.

To compare the effect of the candidate integration site on cytotoxicity versus prime-independent cytotoxicity, T cells that had undergone circuit cassette integration with PrimeR at GS79 (TRAC) integration site and GS94 integration site were cocultured with K562 CD19+/MSLN+ cells or K562 CD19−/MSLN+ cells ("K562_MSLN") at day 7 post-electroporation for 48 hours. 0.3, 1.0, and 3.0 E:T cell ratios were tested. See FIG. 35A and FIG. 35B. At 48 h post initiation of coculture, cytotoxicity was analyzed by measuring luciferase activity of remaining target cells As shown in FIG. 35B, the GS94 integration site resulted in equivalent cytotoxic potential to the TRAC integration site and there was no prime-independent cytotoxicity.

Prime-Independent Cytokine Section

Figures 36A, 36B:
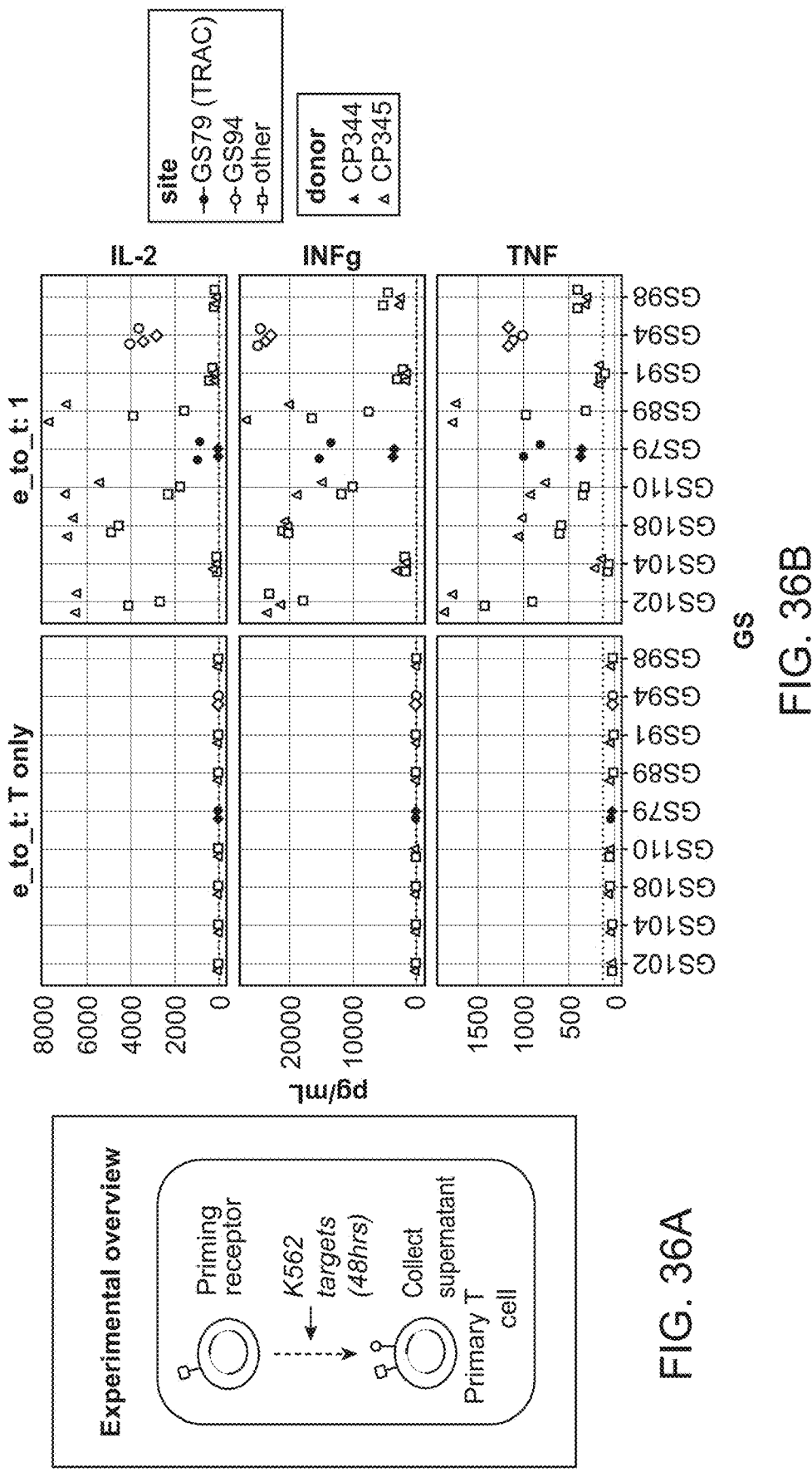
FIG. 36A includes a schematic showing the experimental overview for evaluating the effect of integration site on cytokine secretion.
FIG. 36B includes plots showing the measured cytokine levels for engineerred T cells cocultured for 48 hours with K562 CD19+/MSLN+ cells.

To compare the effect of the candidate integration site on cytoxicity versus prime-independent cytotoxicity, T cells that had undergone circuit cassette integration with PrimeR at GS79 (TRAC) integration site and GS94 integration site, generated as described above, were cocultured with K562 CD19+/MSLN+ cells. A group that had target cells only (E:T=0; Targets only) was compared to a group with an E:T cell ratio of 1. Following the 48 h coculture with the K562 CD19+/MSLN+ cells, supernatant was collected and analyzed via Luminex for cytokine levels to measure secretion of IL-2, INFg and TNF cytokines. See FIG. 36A and FIG. 36B. As shown in FIG. 36B, the GS94 integration site resulted in equivalent cytokine secretion to the TRAC integration site and and there was no prime-independent secretion of IL-2, INFg or TNF.

Prime-Independent CAR Expression

Figure 37:
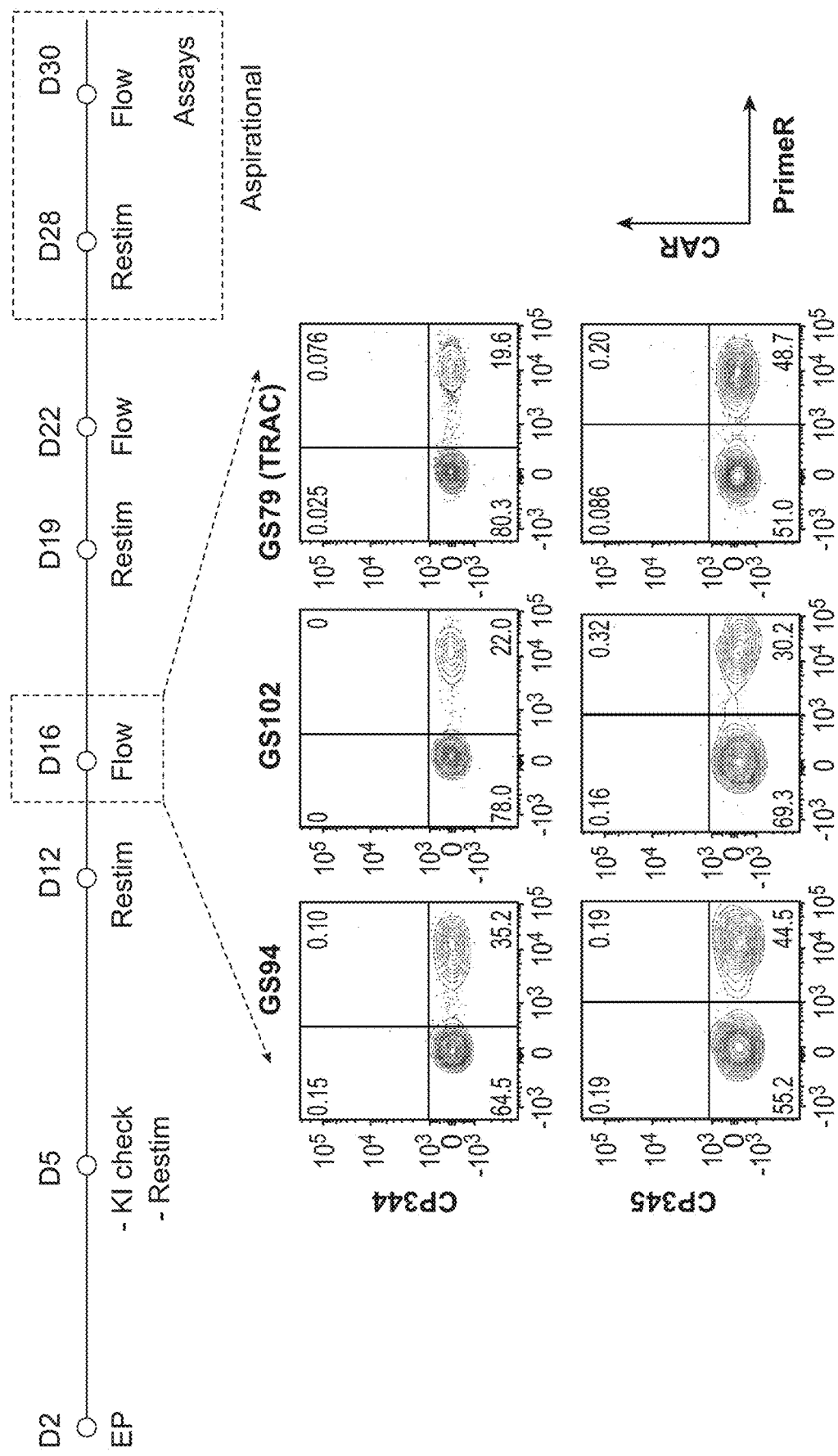
FIG. 37 includes a schematic showing the in vitro experiment conducted to determine the effect of integration site on primeR-independent CAR expression. "Flow" refers to flow cytometry and "restim" refers to repetitive CD3/CD28 stimulation of the engineered T cells. "EP" refers to electroporation.

To evaluate the effect of the candidate integration site on prime-independent CAR expression, T cells that had undergone circuit cassette integration with PrimeR at GS79 (TRAC) integration site, GS94 integration site, and GS102 integration site were cultured in vitro for 32 days. The cells were treated with repetitive CD3/CD28 stimulation at days 5, 12, 19 and 28 of the experiment. On Day 16, the cells were evaluated for CAR expression using a flow cytometry assay. As shown in FIG. 37, T cell activation through TCR did not result in prime R-independent CAR expression from circuit cassette integration at the candidate integration sites.

T cells generated as described above were cultured in 96-well plates, with T cell growth medium being exchanged every 2 days. At days 5, 12, 19 and 28, T cells were stimulated with 1:1 CD3/CD28 Dynabeads. Cells were analyzed for PrimeR expression by myc epitope tag staining, and for CAR expression by FLAG epitope tag staining at the indicated time points. Flow analysis was performed on an Attune NxT flow cytometer.

Example 7: Evaluating Stability of Prime Receptor Expression Over Several Weeks

Figure 38A:
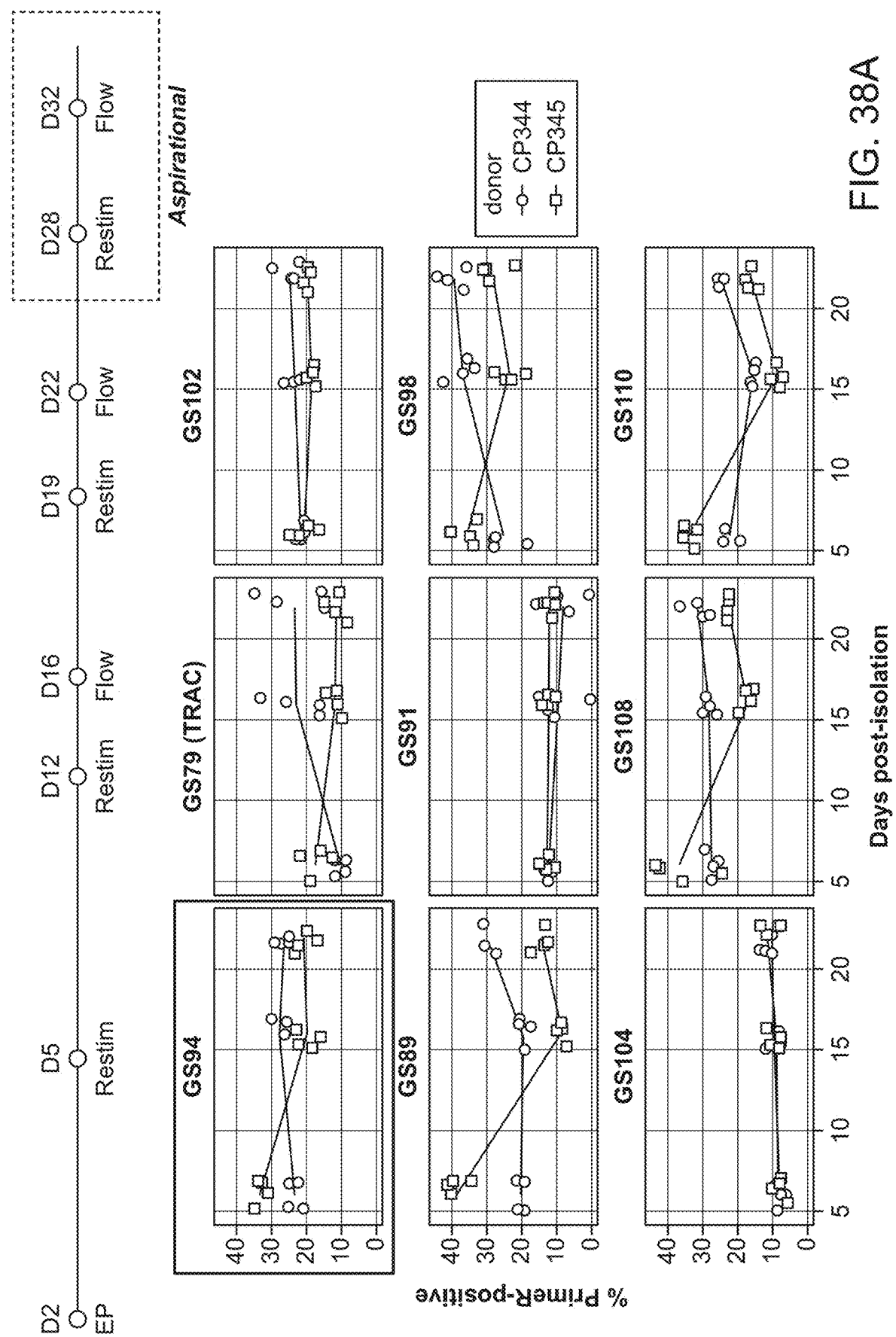
FIGS. 38A and 38B include plots showing the stability of PrimeR expression over time when using the indicated integration sites. "Flow" refers to flow cytometry and "restim" refers to repetitive CD3/CD28 stimulation of the engineered T cells. "EP" refers to electroporation.
Figure 38B:
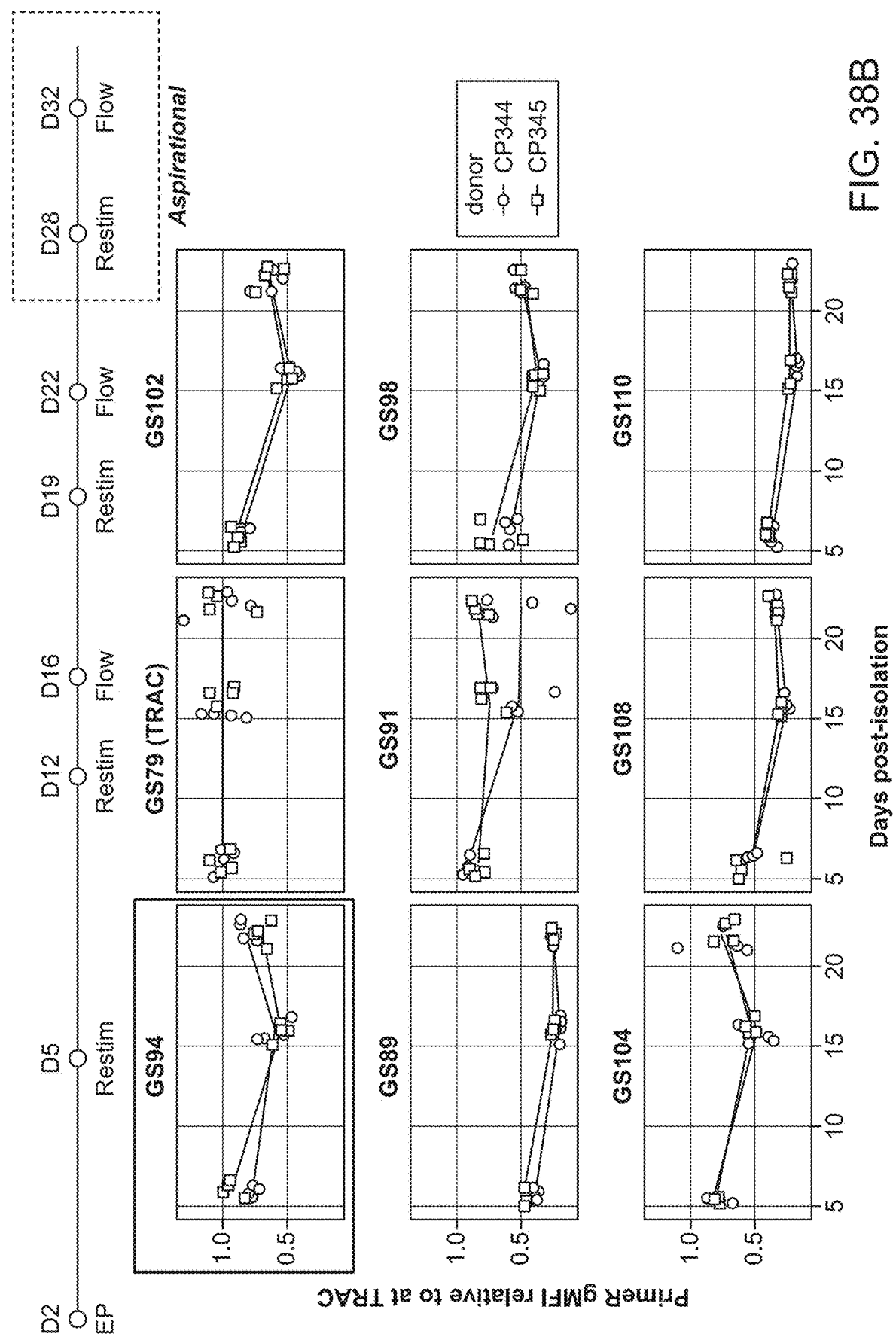

To evaluate the effect of the candidate integration sites on stable (sustained) expression of PrimeR, T cells that had undergone circuit cassette integration with PrimeR at the integration sites indicated in FIG. 38 were cultured in vitro for 32 days. Briefly, T cells generated as described above were cultured in 96-well plates, with T cell growth medium being exchanged every 2 days. At days 5, 12, 19 and 28, T cells were stimulated with 1:1 CD3/CD28 Dynabeads repetitive stimulation. Flow cytometry assays were run on days 16 and 32 using an Attune NxT flow cytometer. The cells were analyzed for PrimeR expression by myc epitope tag staining. As shown in FIGS. 38A and 38B, the GS94 integration site resulted in stable PrimeR expression over at least a 4-week period.

Example 8: Evaluation of On-Target Editing Efficiency

Figure 39B:
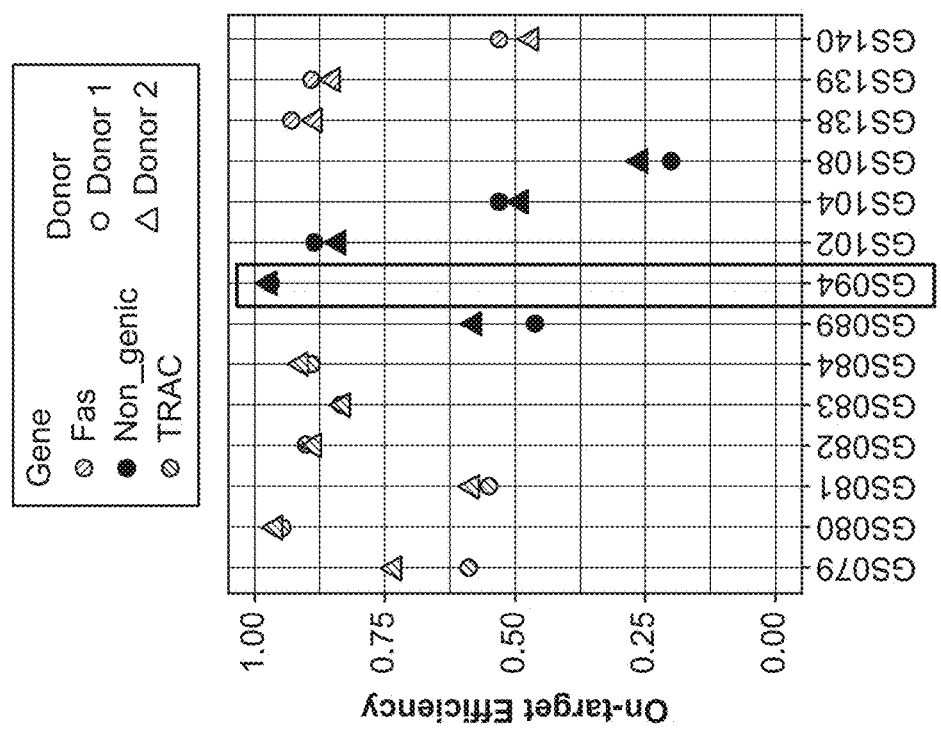
FIG. 39B includes a plot showing the on-target efficiency, using iGuide Seq assay, for the indicated integration sites.
Figure 39A:
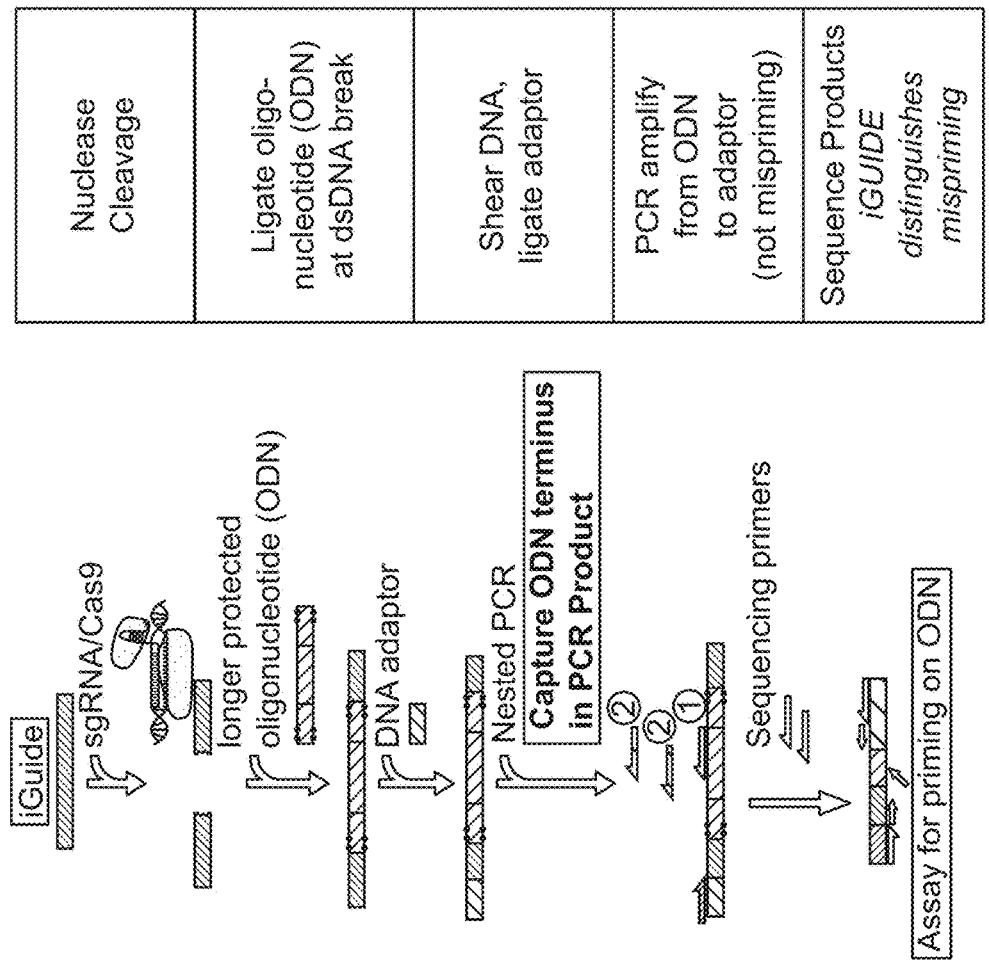
FIG. 39A includes a schematic showing the iGuide-Seq assay technique.

To evaluate the on-target editing efficiency of candidate knock-in sites, iGUIDE-Seq assay was used. The methods used for conducting the iGUIDE-Seq assay are illustrated in FIG. 39A and provided in Nobles et al., Genome Biology (2019), which is hereby incorporated by reference in its entirety. As shown in FIG. 39B, the GS94 integration site had the highest on-target editing efficiency of the evaluated candidate integration sites. As shown in FIG. 39C, GS94 resulted in no putative off-target editing as observed with two donors.

Example 9: Evaluation of GS94 Knock-In

Methods

Elevation prediction: Computational predictions of potential off-target sites from (gs94) were performed using Elevation-search (algorithm described in Listgarten et al. 2018. Prediction of off-target activities for the end-to-end design of CRISPR guide RNAs. Nat Biomed Engr 2, 37-48; software obtained from github.com/Microsoft/Elevation). All sites identified by Elevation-search were subjected to analysis using rhAmp-seq.

rhAmpSeq: 49 candidate off-target sites for GS94 identified by iGUIDE or the Elevation prediction algorithm and the GS94 target site were characterized by rhAmpSeq (Integrated DNA Technologies, Inc.). This targeted amplification enables NGS-based quantification of the editing occurring at numerous sites simultaneously. Genomic DNA from T cells from at least 2 donors that had been treated singly with each of the following 7 guides: GS84, GS94, GS95, GS96, GS102, GS108, and GS138 was isolated with the GenFind V3 DNA purification system (Beckman Coulter). Two separate rhAmpSeq amplification pools were used to cover the 50 loci, the procedure was performed as recommended by Integrated DNA Technologies for each of the samples. The rhAmpSeq libraries were sequenced on a MiniSeq with a Mid Output Kit (300-cycles) (Illumina). The CRISPResso2 algorithm (github.com/pinellolab/CRISPResso2) was used to determine the percentage of insertions and deletions at each of the amplified loci. Statistical significance (FDR-adjusted p-value <0.001) using a chi-squared test was only observed at the GS94 site.

RNA-seq: To evaluate changes induced by GS94 integration at the transcriptional level, a CD19/MSLN circuit was integrated at the GS79 (TRAC), GS94, and GS102 integration sites. On day 6 post-integration, 1e6 edited cells were sorted using a BD FACSAria based on transgene expression. RNA was isolated from sorted T cells with the RNeasy kit (Qiagen). Purified RNA was converted into an NGS library using the TruSeq RNA Library Prep Kit v2 (Illumina). Libraries were sequenced on either the NovaSeq 6000 or NextSeq 550 instruments (Illumina). The STAR 2.7.3a aligner (Dobin A. et al. Bioinformatics. 2013. 29:15-21) was used to align the RNA-seq data against the reference human GRCh38 transcriptome and to obtain gene-level read counts. edgeR (Robinson M D et al. Bioinformatics. 2010. 26: 139-140) was used to compute differential expression, combining data across both donors. The only genes within 300 Kb of the GS94 site, ETS1 and FLI1, were not differentially expressed in cells with integration at the GS94 integration site compared to cells with integration at any of the other two loci. At an FDR-adjusted p-value cutoff of 0.01, the number of differentially expressed genes was minimal (<100 genes genome-wide).

Figure 43:
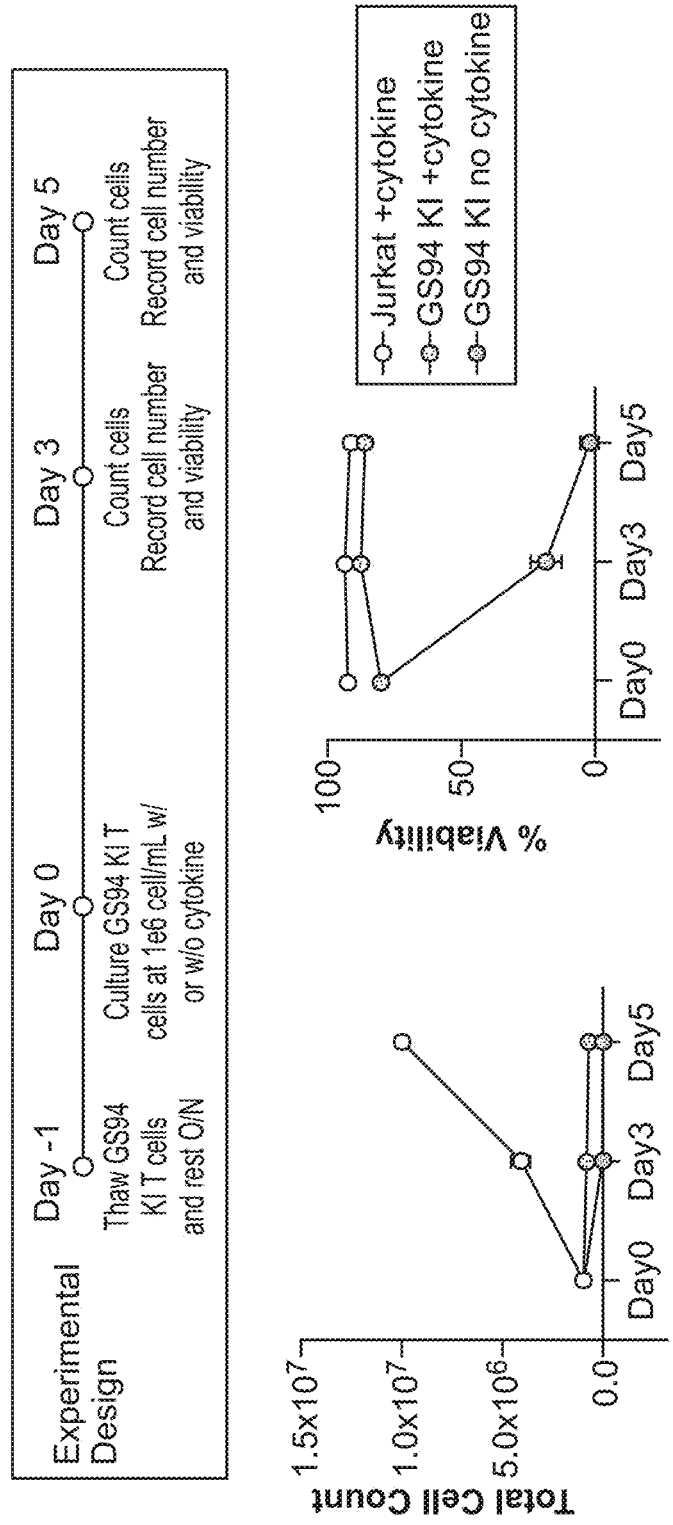
FIG. 43 includes plots showing the absence of cytokine-independent growth in cells with CD19/MSLN circuit KI at GS94.

Cytokine-independent growth assay: To evaluate the safety of the primary T cells with GS94 locus KI, cytokine-independent growth assay was performed to evaluate the potential for oncogenic transformation. Briefly, primary human T cells that had undergone CD19/MSLN circuit cassette integration at GS94 locus were thawed and recovered overnight. 1×10⁶ cells were then seeded in one well of a 24 well-GRex plate, culturing for 5 days in the medium with or without cytokines. Cell number and viability were recorded at days 0, 3 and 5. As a positive control, 1×10⁶ Jurkat cells were cultured in the medium without cytokines in parallel. As shown in FIG. 43, while GS94 KI T cells maintained good viability and total cell count when cultured with cytokine, the viability of GS94 KI T cells drastically decreased over the course of 5 days when cultured without cytokine and there was no viable cell left on day 5. The positive control Jurkat cells maintained good viability and expansion without cytokine throughout the assay. Taken together, this data shows that GS94 edited primary human T cells still depend on exogenous cytokine for growth, survival and expansion, therefore, there is no concern for cellular transformation.

Results

Figure 40:
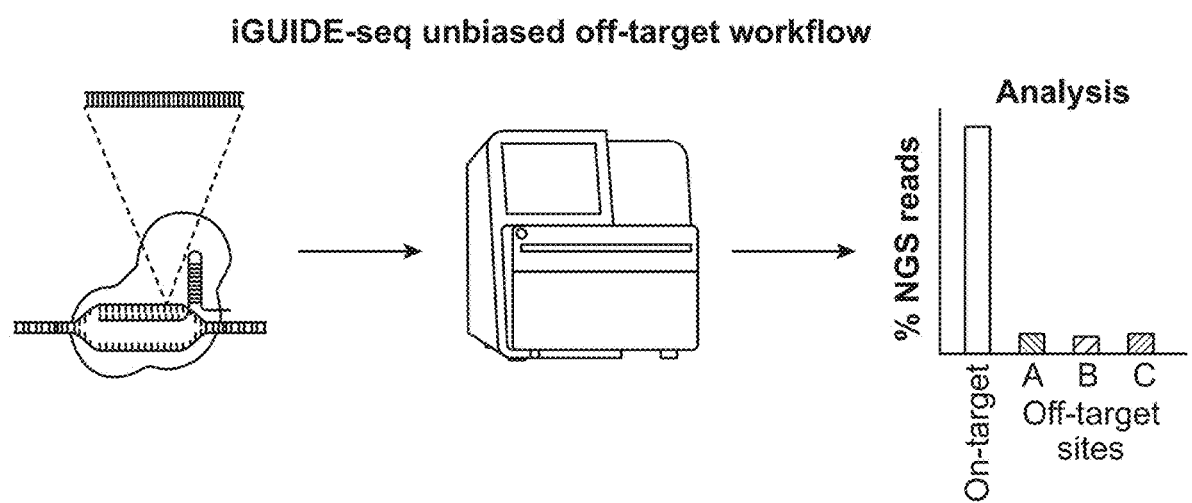
FIG. 40 includes a schematic showing the iGuide-Seq workflow and data.
Figure 40:
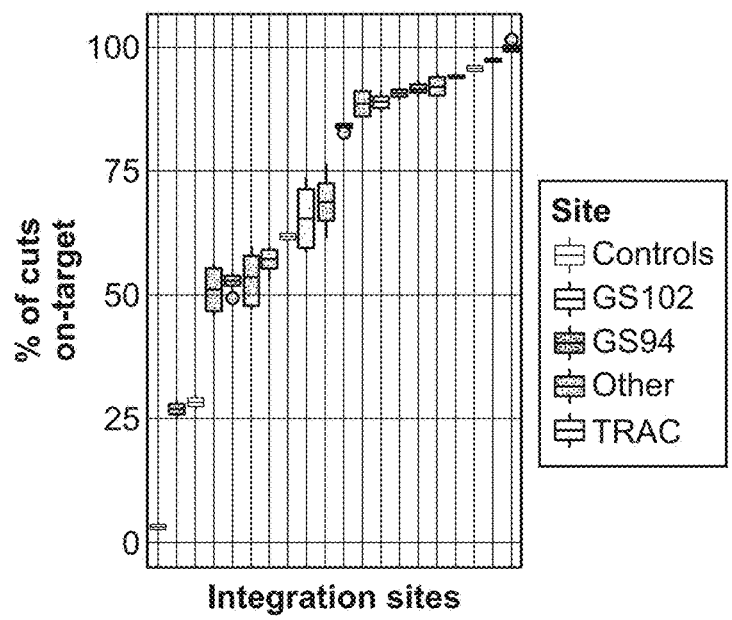

The specificity of CRISPR reagents (e.g. SpCas9 complexed with sgRNA) targeting candidate loci including GS94 was evaluated by iGUIDE-seq (FIG. 40). GS94-targeting CRISPR RNP showed the highest percentage of iGUIDE-seq oligo cassette trapping events of all candidates evaluated, and the control sgRNA sequences from the iGUIDE-seq paper showed similar specificities to what was reported in the original publication, suggesting that the assay performed as expected.

Figure 41:
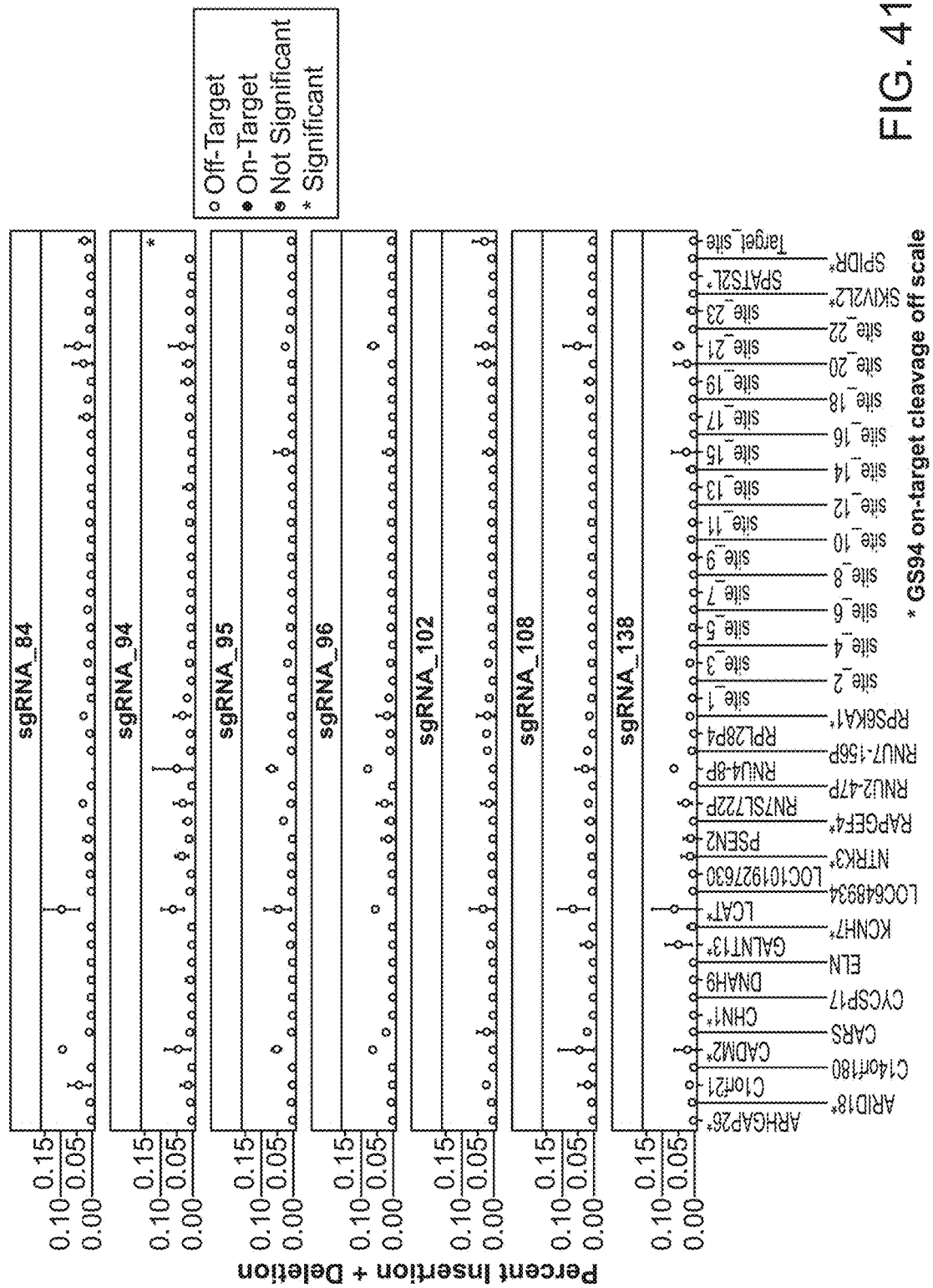
FIG. 41 includes a plot showing rhAmp-seq analysis of putative off-target sites identified by iGUIDE-seq and Elevation prediction.

Putative off-target sites were taken from the iGUIDE-seq output, which already suggested that the putative sites were spurious. Additional target sites were predicted by a computational approach (Elevation software package). rhAmp-seq was used to prepare high-throughput sequencing libraries for each of the putative off-target sites, and the method was applied to DNA samples from T cells electroporated with CRISPR RNPs targeting the candidate target sites. The resulting NGS data were processed with CRISPResso2 software, and the frequency of insertions and deletions (indels) was taken as indication of CRISPR cleavage activity, as is common in the field. T cells electroporated with GS94-targeting CRISPR RNP showed no greater frequency of indels at the set of putative off-target sites than T cells treated with CRISPR RNP targeting other sites, consistent with the GS94-targeting CRISPR RNP having no consequential or detectable off-target activity, and therefore being the most specific out of the set evaluated (FIG. 41).

Figure 42:
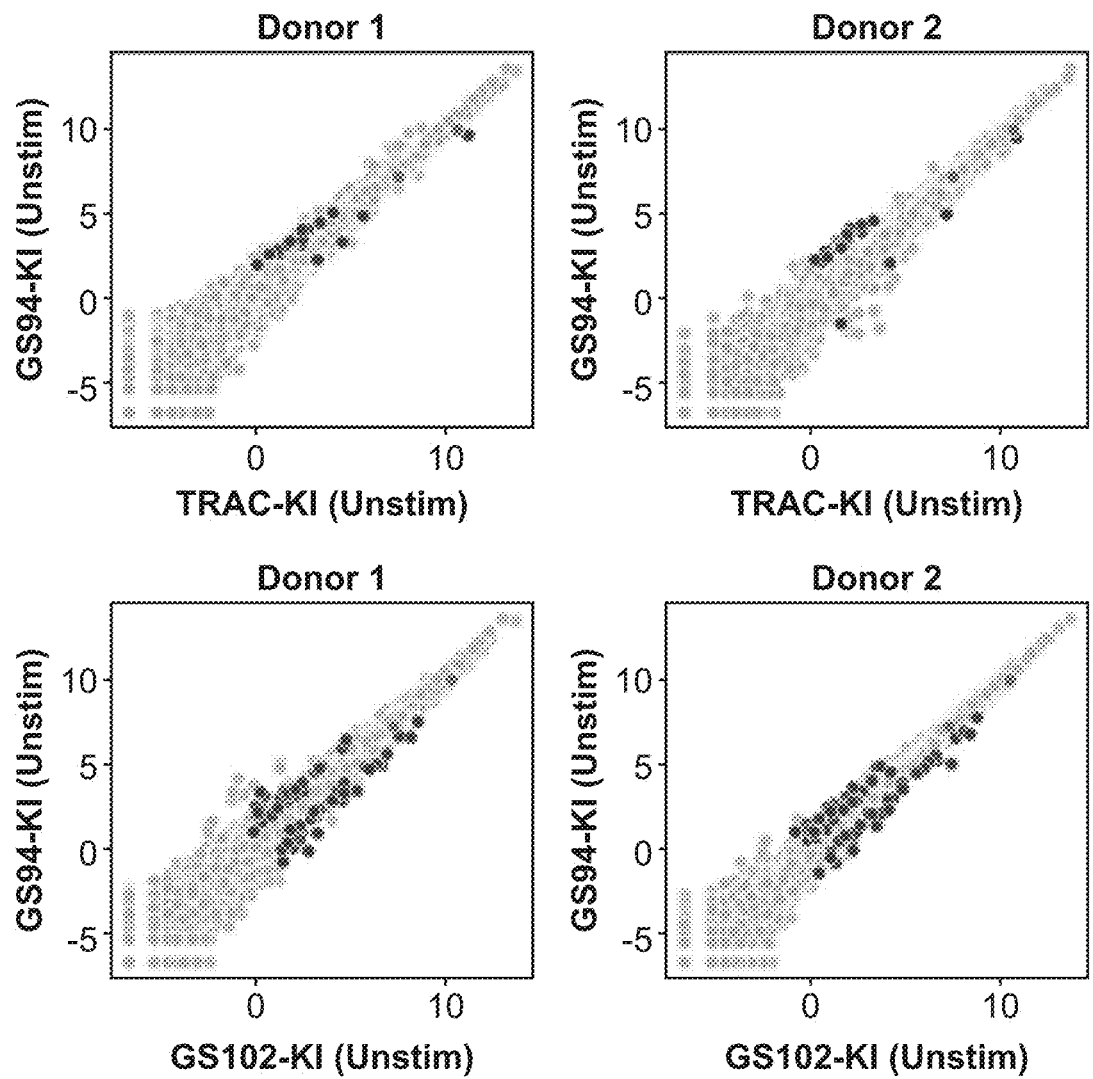
FIG. 42 includes plots showing RNA-seq analysis of cells with GS94, GS102 and TRAC knock-in of CD19/MSLN circuits. Scatterplot of gene expression in cells with integration at the GS94 locus (y-axis) vs cells with integration at either the TRAC or the GS102 locus (x-axis) in two donors. The yellow dots correspond to ETS1 and FLI1. In blue are the genes that were found to be differentially expressed using edgeR (fold-change >0, FDR-corrected p-value <0.01, average counts-per-million across compared conditions at least 2).

Potential effects of transgene integration at the GS94 site on the regulation of the T cell transcriptome were evaluated by knocking in a large cassette to the site, growing T cells for several days, sorting cells expressing the transgene within the cassette, and then collecting RNA from the cells. RNA-seq libraries were prepared and sequenced, and analysis of the resulting Illumina sequencing data revealed no biologically or statistically significant differences in expression of any genes within 300 kb of the GS94 site in cells with integrations at GS94 compared to cells with integration at TRAC or the GS102 sites (FIG. 42). Furthermore, other gene expression differences that reached statistical significance were minimal in number and in effect size, consistent with them being noise in the comparison.

To assess whether transgene integration at GS94 could confer a transformed phenotype, cells with integrations at the GS94 site were cultured with and without cytokines in vitro. Cells remained alive and viable with cytokine addition, but died without cytokine supplementation and lost their viability (FIG. 43). The positive control Jurkat cells remained viable and proliferated. Overall, this indicates that integration of a transgene at GS94 does not confer capacity for cytokine-independent growth, which is a hallmark of T cell transformation.

Example 10: In Vivo Insertion of a CAR Expressing Cassette

In vivo efficacy of T cells with a transgene cassette expressing a CAR recognizing a tumor antigen, or a CAR recognizing a tumor antigen under control of a priming receptor recognizing an antigen in the anatomical vicinity of the tumor, is assessed against human tumor cells such as K562 engineered to express the CAR antigen or to express antigens recognized by both the priming receptor and the CAR. Tumor cells (e.g. 1e6) are subcutaneously injected into the flank of NSG mice (Jackson Laboratories). Tumor growth is assessed by dimensional measurement by calipers every 2-4 days. When the tumor volume reaches ~100 cubic mm, mice are intravenously injected with 5e6 T cells with a CAR or prime-CAR circuit cassette integrated at a specific site by CRISPR-mediated insertion, or with T cells engineered with CRISPR RNP alone, or with PBS alone as a sham injection. Tumor growth is monitored and mice are euthanized when tumor volume reaches 2000 cubic mm. Peripheral blood is bled from mice through a retro-orbital procedure, and flow cytometry and/or ddPCR is used to observe engineered T cell expansion over time. At time of sacrifice, spleen, blood, tumor and/or other tissue is analyzed via flow cytometry, ddPCR, and/or immunohistochemistry for the presence of engineered T cells. The results demonstrate that T cells engineered with cassette integration at one of the defined genomic loci lead to tumor regression and clearance in injected mice as compared to T cells without cassette integration, and that engineered T cells are detectable in the peripheral blood and tissues of injected mice.

REFERENCES

Eyquem, J., Mansilla-Soto, J., Giavridis, T., van der Stegen, S. J., Hamieh, M., Cunanan, K. M., . . . & Sadelain, M. (2017). Targeting a CAR to the TRAC locus with CRISPR/Cas9 enhances tumour rejection. *Nature,* 543 (7643), 113-117.

Sadelain, M., Papapetrou, E. P., & Bushman, F. D. (2012). Safe harbours for the integration of new DNA in the human genome. *Nature reviews Cancer,* 12(1), 51-58.

Irion, S., Luche, H., Gadue, P., Fehling, H. J., Kennedy, M., & Keller, G. (2007). Identification and targeting of the ROSA26 locus in human embryonic stem cells. *Nature biotechnology,* 25(12), 1477-1482.

Pellenz, S., Phelps, M., Tang, W., Hovde, B. T., Sinit, R. B., Fu, W., . . . & Monnat Jr, R. J. (2019). New human chromosomal sites with "safe harbor" potential for targeted transgene insertion. *Human gene therapy,* 30(7), 814-828.

Roth, T. L., Li, P. J., Nies, J. F., Yu, R., Nguyen, M. L., Lee, Y., . . . & Nguyen, D. N. (2019). Rapid discovery of synthetic DNA sequences to rewrite endogenous T cell circuits. *bioRxiv,* 604561.

TABLE 4

SGRNA SEQUENCES USED FOR EVALUATION OF PREDICTED LOCI

| sgRNA ID | sgRNA Sequence | sgRNA_start_coor GRCH38 | sgRNA Target Loci | Integration Site | Median (% Modified), summarized from 2 donors, 2 primersets |
|---|---|---|---|---|---|
| sgRNA_1 | GCACCTGAATACCACGCCTG (SEQ ID NO: 1) | chr16: 88811818 | APRT | APRT | 79.28 |
| sgRNA_2 | CGCCTGCGATGTAGTCGATG (SEQ ID NO: 2) | chr16: 88811551 | APRT | APRT | 78.60 |
| sgRNA_3 | CAGGACGGGCGAGATGTCCC (SEQ ID NO: 3) | chr16: 88811640 | APRT | APRT | 85.25 |
| sgRNA_4 | CTGAATCTTTGGAGTACCTG (SEQ ID NO: 4) | chr15: 44715425 | B2M | B2M | 78.51 |
| sgRNA_5 | GGCCACGGAGCGAGACATCT (SEQ ID NO: 5) | chr15: 44711550 | B2M | B2M | 94.75 |
| sgRNA_6 | AAGTCAACTTCAATGTCGGA (SEQ ID NO: 6) | chr15: 44715515 | B2M | B2M | 70.97 |
| sgRNA_7 | GCTTGGAGGCCTGATCAGCG (SEQ ID NO: 7) | chr19: 36141111 | CAPNS1 | CAPNS1 | 89.34 |
| sgRNA_8 | CTTATCTCTTCGCAGCGAGG (SEQ ID NO: 8) | chr19: 36142301 | CAPNS1 | CAPNS1 | 91.09 |
| sgRNA_9 | CACACATTACTCCAACATTG (SEQ ID NO: 9) | chr19: 36142676 | CAPNS1 | CAPNS1 | 71.98 |
| sgRNA_10 | TTCCGCAAAATAGAGCCCCA (SEQ ID NO: 10) | chr3: 105746019 | CBLB | CBLB | 91.55 |
| sgRNA_11 | TGCACAGAACTATCGTACCA (SEQ ID NO: 11) | chr3: 105751622 | CBLB | CBLB | 91.43 |
| sgRNA_12 | GCAATAAGACTCTTTAAAGA (SEQ ID NO: 12) | chr3: 105853470 | CBLB | CBLB | 76.18 |
| sgRNA_13 | CAAAGAGATTACGAATGCCT (SEQ ID NO: 13) | chr1: 116754658 | CD2 | CD2 | 89.80 |
| sgRNA_14 | CAAGGCACCCCAGGTTTCCA (SEQ ID NO: 14) | chr1: 116754663 | CD2 | CD2 | 92.70 |
| sgRNA_15 | TTACGAATGCCTTGGAAACC (SEQ ID NO: 15) | chr1: 116754666 | CD2 | CD2 | 92.82 |
| sgRNA_16 | CAGAGACGCATCTGACCCTC (SEQ ID NO: 16) | chr11: 118315540 | CD3E | CD3E | 90.96 |
| sgRNA_17 | CATGCAGTTCTCACACACTG (SEQ ID NO: 17) | chr11: 118313715 | CD3E | CD3E | 87.47 |
| sgRNA_18 | GTGTGAGAACTGCATGGAGA (SEQ ID NO: 18) | chr11: 118313715 | CD3E | CD3E | 86.65 |
| sgRNA_19 | TCTCATTTCAGGAAACCACT (SEQ ID NO: 19) | chr11: 118349748 | CD3G | CD3G | 87.24 |
| sgRNA_20 | AGTCATACACCTTAACCAAG (SEQ ID NO: 20) | chr11: 118349754 | CD3G | CD3G | 87.99 |
| sgRNA_21 | TTCAAGGAAACCAGTTGAGG (SEQ ID NO: 21) | chr11: 118352458 | CD3G | CD3G | 86.55 |
| sgRNA_22 | GAGCCTTGCCTGGAAATCTG (SEQ ID NO: 22) | chr11: 61118177 | CD5 | CD5 | 84.03 |
| sgRNA_23 | AAGCGTCAAAAGTCTGCCAG (SEQ ID NO: 23) | chr11: 61118324 | CD5 | CD5 | 89.19 |
| sgRNA_24 | CGTTCCAACTCGAAGTGCCA (SEQ ID NO: 24) | chr11: 61118121 | CD5 | CD5 | 83.11 |

TABLE 4-continued

SGRNA SEQUENCES USED FOR EVALUATION OF PREDICTED LOCI

| sgRNA ID | sgRNA Sequence | sgRNA_start_coor GRCH38 | sgRNA Target Loci | Integration Site | Median (% Modified), summarized from 2 donors, 2 primersets |
|---|---|---|---|---|---|
| sgRNA_25 | GAGCGACTGGGACACGGTGA (SEQ ID NO: 25) | chr9: 136866246 | EDF1 | EDF1 | 88.84 |
| sgRNA_26 | GCTGCGCAAGAAGGGCCCTA (SEQ ID NO: 26) | chr9: 136866211 | EDF1 | EDF1 | 91.04 |
| sgRNA_27 | TTGTTCTGGCCAGCAGCCCC (SEQ ID NO: 27) | chr9: 136863433 | EDF1 | EDF1 | 85.98 |
| sgRNA_28 | CTTCCAGAGCCACATCATCG (SEQ ID NO: 28) | chr19: 48965791 | FTL | FTL | 93.10 |
| sgRNA_29 | GGGACTCACCAGAGAGAGGT (SEQ ID NO: 29) | chr19: 48965601 | FTL | FTL | 88.86 |
| sgRNA_30 | CGGTCGAAATAGAAGCCCTA (SEQ ID NO: 30) | chr19: 48965770 | FTL | FTL | 93.14 |
| sgRNA_31 | AAAAGGATATTGTGCAACTG (SEQ ID NO: 31) | chr10: 87933015 | PTEN | PTEN | 92.37 |
| sgRNA_32 | TGTGCATATTTATTACATCG (SEQ ID NO: 32) | chr10: 87933183 | PTEN | PTEN | 90.64 |
| sgRNA_33 | TTTGTGAAGATCTTGACCAA (SEQ ID NO: 33) | chr10: 87933087 | PTEN | PTEN | 85.36 |
| sgRNA_34 | TGTCATGCTGAACCGCATTG (SEQ ID NO: 34) | chr18: 12830972 | PTPN2 | PTPN2 | 87.94 |
| sgRNA_35 | CCACTCTATGAGGATAGTCA (SEQ ID NO: 35) | chr18: 12859219 | PTPN2 | PTPN2 | 92.45 |
| sgRNA_36 | TTGACATAGAAGAGGCACAA (SEQ ID NO: 36) | chr18: 12836828 | PTPN2 | PTPN2 | 93.96 |
| sgRNA_37 | GAGTACTACACTCAGCAGCA (SEQ ID NO: 37) | chr12: 6952098 | PTPN6 | PTPN6 | 89.61 |
| sgRNA_38 | TCACGCACAAGAAACGTCCA (SEQ ID NO: 38) | chr12: 6954872 | PTPN6 | PTPN6 | 82.74 |
| sgRNA_39 | AGGTCTCGGTGAAACCACCT (SEQ ID NO: 39) | chr12: 6951610 | PTPN6 | PTPN6 | 91.27 |
| sgRNA_40 | AGCATTATCCAAAGAGTCCG (SEQ ID NO: 40) | chr1: 198696873 | PTPRC | PTPRC | 88.88 |
| sgRNA_41 | ATATTAATTCTTACCAGTGG (SEQ ID NO: 41) | chr1: 198692370 | PTPRC | PTPRC | 88.95 |
| sgRNA_42 | AGCTTTAAATCAAGGTTCAT (SEQ ID NO: 42) | chr1: 198756176 | PTPRC | PTPRC | 96.89 |
| sgRNA_43 | ATCCCGAGCCCTAAGGTGCA (SEQ ID NO: 43) | chr11: 67436325 | PTPRCAP | PTPRCAP | 84.08 |
| sgRNA_44 | GGCAGCGCGGAGGACAGCGT (SEQ ID NO: 44) | chr11: 67436285 | PTPRCAP | PTPRCAP | 97.74 |
| sgRNA_45 | CTCAGGGGCTACTACCACC (SEQ ID NO: 45) | chr11: 67436170 | PTPRCAP | PTPRCAP | 91.50 |
| sgRNA_46 | GTCACCGACGAGACCAGAAG (SEQ ID NO: 46) | chr5: 82277810 | RP523 | RP523 | 79.40 |
| sgRNA_47 | GTCGTGGACTTCGTACTGCT (SEQ ID NO: 47) | chr5: 82277843 | RP523 | RP523 | 83.07 |

TABLE 4-continued

SGRNA SEQUENCES USED FOR EVALUATION OF PREDICTED LOCI

| sgRNA ID | sgRNA Sequence | sgRNA_start_coor GRCH38 | sgRNA Target Loci | Integration Site | Median (% Modified), summarized from 2 donors, 2 primersets |
|---|---|---|---|---|---|
| sgRNA_48 | TAATTTTTAGGCAAGTGTCG (SEQ ID NO: 48) | chr5: 82277860 | RP523 | RP523 | 61.94 |
| sgRNA_49 | TTAGCTGTTAGACTTGAATA (SEQ ID NO: 49) | chr14: 51993810 | RTRAF | RTRAF | 85.50 |
| sgRNA_50 | CGAGAGCCGTCAACTTGCGT (SEQ ID NO: 50) | chr14: 51989652 | RTRAF | RTRAF | 85.64 |
| sgRNA_51 | CGGCTTCAACTGCAAAGGTG (SEQ ID NO: 51) | chr14: 51989700 | RTRAF | RTRAF | 88.77 |
| sgRNA_52 | TATGAAAAGCAGAGCGACT (SEQ ID NO: 52) | chr15: 43793025 | SERF2 | SERF2 | 89.61 |
| sgRNA_53 | TCTGGCGGGCGAGCTCACGC (SEQ ID NO: 53) | chr15: 43792989 | SERF2 | SERF2 | 86.73 |
| sgRNA_54 | CTCACGCTGGTTACCGCCTA (SEQ ID NO: 54) | chr15: 43792977 | SERF2 | SERF2 | 80.57 |
| sgRNA_55 | AAAGATTACGAACTTCCCTG (SEQ ID NO: 55) | chr12: 46207559 | SLC38A1 | SLC38A1 | 92.24 |
| sgRNA_56 | GTTAAAAACAGACATGCCTA (SEQ ID NO: 56) | chr12: 46229232 | SLC38A1 | SLC38A1 | 91.51 |
| sgRNA_57 | ATGCCTAAGGAGGTTGTACC (SEQ ID NO: 57) | chr12: 46229246 | SLC38A1 | SLC38A1 | 79.48 |
| sgRNA_58 | CTCCAGGTATCCCATCGAAA (SEQ ID NO: 58) | chr18: 47869418 | SMAD2 | SMAD2 | 79.53 |
| sgRNA_59 | CACCAAATACGATAGATCAG (SEQ ID NO: 59) | chr18: 47870532 | SMAD2 | SMAD2 | 86.61 |
| sgRNA_60 | TGGCGGCGTGAATGGCAAGA (SEQ ID NO: 60) | chr18: 47896729 | SMAD2 | SMAD2 | 82.91 |
| sgRNA_61 | TAGGATGGTAGCACACAACC (SEQ ID NO: 61) | chr16: 11255478 | SOCS1 | SOCS1 | 92.25 |
| sgRNA_62 | CAGCAGCAGAGCCCCGACGG (SEQ ID NO: 62) | chr16: 11255432 | SOCS1 | SOCS1 | 83.79 |
| sgRNA_63 | CGGCGTGCGAACGGAATGTG (SEQ ID NO: 63) | chr16: 11255296 | SOCS1 | SOCS1 | 84.24 |
| sgRNA_64 | TATAGACGCTGCCCGACGTC (SEQ ID NO: 64) | chr15: 40038895 | SRP14 | SRP14 | 95.12 |
| sgRNA_65 | TCCAAAGAAGGGTACTGTGG (SEQ ID NO: 65) | chr15: 40038368 | SRP14 | SRP14 | 92.14 |
| sgRNA_66 | ACAGTACCCTTCTTTGGAAT (SEQ ID NO: 66) | chr15: 40038358 | SRP14 | SRP14 | 65.82 |
| sgRNA_67 | GCGACGGGCGCATCTACGTG (SEQ ID NO: 67) | chr12: 120469572 | SRSF9 | SRSF9 | 83.68 |
| sgRNA_68 | CCCGACCTCCATAAGTCCTG (SEQ ID NO: 68) | chr12: 120465700 | SRSF9 | SRSF9 | 92.56 |
| sgRNA_69 | GGGGTCCTCGAAGCGCACGA (SEQ ID NO: 69) | chr12: 120469426 | SRSF9 | SRSF9 | 89.94 |
| sgRNA_70 | TGCTCTGTTTAGAAGATGAC (SEQ ID NO: 70) | chr5: 32591641 | SUB1 | SUB1 | 79.36 |
| sgRNA_71 | ATATTCTTTTCTAGTTAAAG (SEQ ID NO: 71) | chr5: 32591566 | SUB1 | SUB1 | 70.93 |

TABLE 4-continued

SGRNA SEQUENCES USED FOR EVALUATION OF PREDICTED LOCI

| sgRNA ID | sgRNA Sequence | sgRNA_start_coor GRCH38 | sgRNA Target Loci | Integration Site | Median (% Modified), summarized from 2 donors, 2 primersets |
|---|---|---|---|---|---|
| sgRNA_72 | CCTGTAAAGAAACAAAAGAC (SEQ ID NO: 72) | chr5: 32591614 | SUB1 | SUB1 | 93.66 |
| sgRNA_73 | TGGAGAAAGACGTAACTTCG (SEQ ID NO: 73) | chr4: 105234315 | TET2 | TET2 | 83.53 |
| sgRNA_74 | TCTGCCCTGAGGTATGCGAT (SEQ ID NO: 74) | chr4: 105234747 | TET2 | TET2 | 90.97 |
| sgRNA_75 | ATTCCGCTTGGTGAAAACGA (SEQ ID NO: 75) | chr4: 105235656 | TET2 | TET2 | 89.62 |
| sgRNA_76 | CAGGCACAATAGAAACAACG (SEQ ID NO: 76) | chr3: 114295571 | TIGIT | TIGIT | 92.65 |
| sgRNA_77 | CCATTTGTAATGCTGACTTG (SEQ ID NO: 77) | chr3: 114295700 | TIGIT | TIGIT | 60.75 |
| sgRNA_78 | CTGGGTCACTTGTGCCGTGG (SEQ ID NO: 78) | chr3: 114295634 | TIGIT | TIGIT | 87.99 |
| sgRNA_79 | GTCAGGGTTCTGGATATCTG (SEQ ID NO: 79) | chr14: 22547508 | TRAC | TRAC | 98.20 |
| sgRNA_80 | TGGATTTAGAGTCTCTCAGC (SEQ ID NO: 80) | chr14: 22547541 | TRAC | TRAC | 88.15 |
| sgRNA_81 | CTGCGGCTGTGGTCCAGCTG (SEQ ID NO: 81) | chr14: 22550661 | TRAC | TRAC | 94.77 |
| sgRNA_82 | ACAAAACTGTGCTAGACATG (SEQ ID NO: 82) | chr14: 22547658 | TRAC | TRAC | 87.86 |
| sgRNA_83 | TTCTTCCCCAGCCCAGGTAA (SEQ ID NO: 83) | chr14: 22547778 | TRAC | TRAC | 89.85 |
| sgRNA_84 | CGTCATGAGCAGATTAAACC (SEQ ID NO: 84) | chr14: 22550625 | TRAC | TRAC | 95.81 |
| sgRNA_85 | GAGAGCGCCTGCGACCCGAG (SEQ ID NO: 85) | chr19: 58544980 | TRIM28 | TRIM28 | 89.44 |
| sgRNA_86 | CCAGCGGGTGAAGTACACCA (SEQ ID NO: 86) | chr19: 58544869 | TRIM28 | TRIM28 | 94.79 |
| sgRNA_87 | GGAGCGCTTTTCGCCGCCAG (SEQ ID NO: 87) | chr19: 58544839 | TRIM28 | TRIM28 | 91.81 |
| sgRNA_88 | TGAGGCCTGGACCTTATGCA (SEQ ID NO: 88) | chr10: 33134193 | chr10: 33130000-33140000 | desert_1 (GS88) | 69.44 |
| sgRNA_89 | CCTGGTGGAGTGAACCATGA (SEQ ID NO: 89) | chr10: 33132917 | chr10: 33130000-33140000 | desert_1 (GS89) | 95.25 |
| sgRNA_90 | CAAGCACTTAGGTTCCCCTG (SEQ ID NO: 90) | chr10: 33134633 | chr10: 33130000-33140000 | desert_1 (GS90) | 91.13 |
| sgRNA_91 | GGTCTCCCTACAATTCAGCG (SEQ ID NO: 91) | chr10: 72294568 | chr10: 72290000-72300000 | desert_2 (GS91) | 92.02 |
| sgRNA_92 | CACAGCGCGTGACTGCAATG (SEQ ID NO: 92) | chr10: 72298268 | chr10: 72290000-72300000 | desert_2 (GS92) | 90.22 |

TABLE 4-continued

SGRNA SEQUENCES USED FOR EVALUATION OF PREDICTED LOCI

| sgRNA ID | sgRNA Sequence | sgRNA_start_coor GRCH38 | sgRNA Target Loci | Integration Site | Median (% Modified), summarized from 2 donors, 2 primersets |
|---|---|---|---|---|---|
| sgRNA_93 | TCTGGGGCACCAATTCTAGG (SEQ ID NO: 93) | chr10: 72292786 | chr10: 72290000-72300000 | desert_2 (GS93) | 86.35 |
| sgRNA_94 | GAGCCATGCTTGGCTTACGA (SEQ ID NO: 94) | chr11: 128342576 | chr11: 128340000-128350000 | desert_3 (GS94) | 91.24 |
| sgRNA_95 | GTACAAGTACTTATCTCATG (SEQ ID NO: 95) | chr11: 128343592 | chr11: 128340000-128350000 | desert_3 (GS95) | 89.02 |
| sgRNA_96 | GAGATAACAACATAACAACA (SEQ ID NO: 96) | chr11: 128347170 | chr11: 128340000-128350000 | desert_3 (GS96) | 96.47 |
| sgRNA_97 | CATATTCCATAGTCTTTGGG (SEQ ID NO: 97) (NEAT1) | chr11: 65425000 | chr11: 65425000-65427000 | desert_4 (GS97) | 88.54 |
| sgRNA_98 | CTGCCCCTTAGCAACTTAGG (SEQ ID NO: 98) | chr11: 65425507 | chr11: 65425000-65427000 (NEAT1) | desert_4 (GS98) | 92.76 |
| sgRNA_99 | TGTTTAAAAATATGTTGACA (SEQ ID NO: 99) | chr11: 65426264 | chr11: 65425000-65427000 (NEAT1) | desert_4 (GS99) | 90.76 |
| sgRNA_100 | CCAGGAATGGAAACTCACGC (SEQ ID NO: 100) | chr15: 92830315 | chr15: 92830000-92840000 | desert_5 (GS100) | 87.84 |
| sgRNA_101 | GAGGCCGCTGAATTAACCCG (SEQ ID NO: 101) | chr15: 92831850 | chr15: 92830000-92840000 | desert_5 (GS101) | 85.32 |
| sgRNA_102 | ATACACGCACACTTGCAGAA (SEQ ID NO: 102) | chr15: 92831131 | chr15: 92830000-92840000 | desert_5 (GS102) | 99.92 |
| sgRNA_103 | GAGCAGACAGAAACCCAGGG (SEQ ID NO: 103) | chr16: 11225670 | chr16: 11220000-11230000 | desert_6 (GS103) | 87.92 |
| sgRNA_104 | TGAGTCTCCAAACAGAACAG (SEQ ID NO: 104) | chr16: 11226284 | chr16: 11220000-11230000 | desert_6 (GS104) | 88.53 |
| sgRNA_105 | TAATATCACTGACTTCACGG (SEQ ID NO: 105) | chr16: 11225029 | chr16: 11220000-11230000 | desert_6 (GS105) | 87.65 |
| sgRNA_106 | TACACACAATGTAAGCAGCA (SEQ ID NO: 106) | chr2: 87467461 | chr2: 87460000-87470000 | desert_7 (GS106) | 71.79 |
| sgRNA_107 | GGGAGCTCAATTCGAAACCA (SEQ ID NO: 107) | chr2: 87468809 | chr2: 87460000-87470000 | desert_7 (GS107) | 65.89 |
| sgRNA_108 | TTGGACAGGTGAGACAGTCG (SEQ ID NO: 108) | chr2: 87467001 | chr2: 87460000-87470000 | desert_7 (GS108) | 72.64 |
| sgRNA_109 | AAGCTCACTCAGATAGTGTG (SEQ ID NO: 109) | chr3: 186511316 | chr3: 186510000-186520000 | desert_8 (GS109) | 76.89 |

TABLE 4-continued

SGRNA SEQUENCES USED FOR EVALUATION OF PREDICTED LOCI

| sgRNA ID | sgRNA Sequence | sgRNA_start_coor GRCH38 | sgRNA Target Loci | Integration Site | Median (% Modified), summarized from 2 donors, 2 primersets |
|---|---|---|---|---|---|
| sgRNA_110 | CAGGAGAACCACCTTACACG (SEQ ID NO: 110) | chr3: 186515260 | chr3: 186510000-186520000 | desert_8 (GS110) | 86.31 |
| sgRNA_111 | GGACAGACCCTGATTCACAA (SEQ ID NO: 111) | chr3: 186519655 | chr3: 186510000-186520000 | desert_8 (GS111) | 85.47 |
| sgRNA_112 | ACATGGCAGTCTATGAACAG (SEQ ID NO: 112) | chr3: 59451154 | chr3: 59450000-59460000 | desert_9 (GS112) | 87.77 |
| sgRNA_113 | CCTATAGAGAGTACTACTTG (SEQ ID NO: 113) | chr3: 59456416 | chr3: 59450000-59460000 | desert_9 (GS113) | 79.33 |
| sgRNA_114 | CCAACCGGGTCTTCATTACG (SEQ ID NO: 114) | chr3: 59457029 | chr3: 59450000-59460000 | desert_9 (GS114) | 92.21 |
| sgRNA_115 | TCAAGCGTAGAGTTCCGAGT (SEQ ID NO: 115) | chr8: 127993006 | chr8: 127980000-128000000 | desert_10 (GS115) | 93.07 |
| sgRNA_116 | TCATGCAATTATGGACCCAG (SEQ ID NO: 116) | chr8: 127994663 | chr8: 127980000-128000000 | desert_10 (GS116) | 89.40 |
| sgRNA_117 | CGGGAAAGTGACTGGCCATG (SEQ ID NO: 117) | chr8: 127996766 | chr8: 127980000-128000000 | desert_10 (GS117) | 87.45 |
| sgRNA_118 | TGAGATTGAAATCAAATCGG (SEQ ID NO: 118) | chr9: 7974159 | chr9: 7970000-7980000 | desert_11 (GS118) | 84.84 |
| sgRNA_119 | TATGCAATATTCATCACGCG (SEQ ID NO: 119) | chr9: 7977914 | chr9: 7970000-7980000 | desert_11 (GS119) | 85.44 |
| sgRNA_120 | AATGTGTTAAATCAAATGCA (SEQ ID NO: 120) | chr9: 7976895 | chr9: 7970000-7980000 | desert_11 (GS120) | 83.48 |

TABLE 5

CONSTRUCTS USED FOR EVALUATION OF PREDICTED LOCI

| Construct name | Sequence | Length |
|---|---|---|
| pARBI-903: APRT_1_Endogenous_1 | ATCTCGGCCAATAAAGGAGAAAGGGCGCGGCCCGTACGCGCGCCAGGTGCGTGGG<br>CGAGACCAGCTCACGCCCCTCCTCCAGCCGCCAAGGCCCCGGCCCACAGCTGCCTGG<br>CTGCAGTCAGAAGCGTAGCCCGAGACAAGGAAGGGCGCCTTGACTCGCACTTTTGT<br>CCGGTTCGAACGTTCTGctcagtggtgcgtggaatgcgagcgcgtcttaaaatcgatggcgcctaggag<br>tccatgaaatacggTACAGGCTTCCGGCGACGGATGCCCCGCCCCTCACCCACGCTCCGC<br>CCTCCGGGGATGCCCCACCCCTCGTGGCGGTCCCGCCCGTCCCCGCGCAGGCGCGCT<br>CGGGCTGCCGCTGGCTCTTCGCACGCGGCCATGGCCGACTCCGAGCTGCAGCTGGT<br>TGAGCAGCGGATCCGCAGCTTCCCCGACTTCCCCACCCCAtccggatccggagagggcagg<br>ggatctctccttacttgtggcgacgtggaggagaaccccggccccATGGTGAGCAAGGGCGAGGAG<br>CTGTTCACCGGGGTGGTGCCCATCCTGGTCGAGCTGGACGGCGACGTAAACGGCCA<br>CAAGTTCAGCGTGTCCGGCGAGGGCGAGGGCGATGCCACCTACGGCAAGCTGACC<br>CTGAAGTTCATCTGCACCACCGGCAAGCTGCCCGTGCCCTGGCCCACCCTCGTGACC<br>ACCCTGACCTACGGCGTGCAGTGCTTCAGCCGCTACCCCGACCACATGAAGCAGCAC<br>GACTTCTTCAAGTCCGCCATGCCCGAAGGCTACGTCCAGGAGCGCACCATCTTCTTC<br>AAGGACGACGGCAACTACAAGACCCGCGCCGAGGTGAAGTTCGAGGGCGACACCC<br>TGGTGAACCGCATCGAGCTGAAGGGCATCGACTTCAAGGAGGACGGCAACATCCTG<br>GGGCACAAGCTGGAGTACAACTACAACAGCCACAACGTCTATATCATGGCCGACAA | 1806 |

TABLE 5-continued

CONSTRUCTS USED FOR EVALUATION OF PREDICTED LOCI

| Construct name | Sequence | Length |
|---|---|---|
| | GCAGAAGAACGGCATCAAGGTGAACTTCAAGATCCGCCACAACATCGAGGACGGCA<br>GCGTGCAGCTCGCCGACCACTACCAGCAGAACACCCCCATCGGCGACGGCCCCGTG<br>CTGCTGCCCGACAACCACTACCTGAGCACCCAGTCCAAGCTGAGCAAAGACCCCAAC<br>GAGAAGCGCGATCACATGGTCCTGCTGGAGTTCGTGACCGCCGCCGGGATCACTCT<br>CGGCATGGACGAGCTGTACAAatgattgtttattgcagcttataatggttacaaataaagcaatagca<br>tcacaaatttcacaaataaagcattttttcactgcattctagttgtggtttgtccaaactcatcaatgtatcttat<br>GGCGTGGTATTCAGGTGCACGCACAGGCCGCCCTCGTGGCGCCCCGACCTGCGGC<br>CTACGGATGGGAGCGCGTGGCCCGCGACCTCCGGGCGGGCGGGGCGGGAACCCTC<br>GTCTTTCGCCCCCGGGGCCCTGCCCTCCTTCGGCCCCGGCGTCACCAGGCCTGTCCTT<br>GGGTCCAGGGACATCTCGCCCGTCCTGAAGGACCCCGCCTCCTTCCGCGCCGCCATC<br>GGCCTCCTGGCGCGACACCTGAAGGCGACCCACGGGGGCCGCATCGACTACATCGC<br>AGGCGAGTGCCCAGTGGCCGCATCTAGGGCGCTTCCGCCTCTGCGCGCGCCGAGGG<br>CAGCACGTGGGCTCTGCGCGTCTGCTTGGGGGAGGGCCTTTGGGGTGCTTCAGGG<br>GGCGCCGGGACGGGCGCCGTGCTTGGGTCGCCCGGGAAGGGTTGTGAGATTGAGC<br>CC (SEQ ID NO: 123) | |
| pARBI-904:<br>APRT_2_En<br>dogenous_<br>2 | TGCCCCGCCCCTCACCCACGCTCCGCCCTCCGGGGATGCCCCACCCCTCGTGGCGGT<br>CCCGCCCGTCCCCGCGCAGGCGCGCTCGGGCTGCCGCTGGCTCTTCGCACGCGGCC<br>ATGGCCGACTCCGAGCTGCAGCTGGTTGAGCAGCGGATCCGCAGCTTCCCCGACTTC<br>CCCACCCCAGGCGTGGTATTCAGGTGCACGCACAGGCCGCCCTCGTGGCGCCCCGA<br>CCTGCGGGCCTACGGATGGGAGCGCGTGGCCCGCGACCTCCGGGCGGGCGGGGCG<br>GGAACCCTCGTCTTTCGCCCCCGGGGCCCTGCCCTCCTTCGGCCCCGGCGTCACCAG<br>GCCTGTCCTTGGGTCCAGGGACATCTCGCCCGTCCTGAAGGACCCCGCCTCCTTCCG<br>CGCCGCCATCGGCCTCCTGGCGCGACACCTGAAGGCGACCCACGGGGGCCGCATCtc<br>cggatccggagagggcaggggatctctccttacttgtggcgacgtggaggagaacccggccccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttcactgcattctagttgtggtttgtcc<br>aaactcatcaatgtatcttatGACTACATCGCAGGCGAGTGCCCAGTGGCCGCATCTAGGG<br>CGCTTCCGCCTCTGCGCGCGCCGAGGGCAGCACGTGGGCTCTGCGCGTCTGCTTGG<br>GGGAGGGCCTTTGGGGTGCTTCAGGGGGCGCCGGGACGGGCGCCGTGCTTGGGTC<br>GCCCGGGAAGGGTTGTGAGATTGAGCCCCCGAGGCCGCCGCGCTGTGCAGGCGTC<br>CTTCCCGCAGGTTCCGGGTCCCCAGCCCAGGACAGGCGTGACCGAGTTGCCGGGTC<br>AGTTGGTCTCCCTGGAGTGCCCAAGCTGAATCCACAGGGCCCAGCTGCCTTGCTTCT<br>TGTTCCTTCTGCGAGCTGGTATTGAGCGCCTGCCACGAGCCAGGCCTTCCCTGGTGA<br>AGATCACGGAATGCCCACCCAGGGAAGGGAGGCCTGGAGGCCTCCGGGAGAGCCC<br>AAGAGGTGGCCCAGGGAGA (SEQ ID NO: 124) | 1806 |
| pARBI-905:<br>APRT_3_En<br>dogenous_<br>3 | CGTTCTGctcagtggtgcgtggaatgcgagcgcgtcttaaaatcgatggcgcctaggagtccatgaaatacg<br>gTACAGGCTTCCGGCGACGGATGCCCCGCCCCTCACCCACGCTCCGCCCTCCGGGGA<br>TGCCCCACCCCTCGTGGCGGTCCCGCCCGTCCCCGCGCAGGCGCGCTCGGGCTGCC<br>GCTGGCTCTTCGCACGCGGCCATGGCCGACTCCGAGCTGCAGCTGGTTGAGCAGCG<br>GATCCGCAGCTTCCCCGACTTCCCCACCCCAGGCGTGGTATTCAGGTGCACGCACAG<br>GCCGCCCTCGTGGCGCCCCGACCTGCGGGCCTACGGATGGGAGCGCGTGGCCCGC<br>GACCTCCGGGCGGGCGGGGCGGGAACCCTCGTCTTTCGCCCCCGGGGCCCTGCCCT<br>CCTTCGGCCCCGGCGTCACCAGGCCTGTCCTTGGGTCCAGGtccggatccggagagggcag<br>gggatctctccttacttgtggcgacgtggaggagaacccggccccATGGTGAGCAAGGGCGAGGA<br>GCTGTTCACCGGGGTGGTGCCCATCCTGGTCGAGCTGGACGGCGACGTAAACGGCC<br>ACAAGTTCAGCGTGTCCGGCGAGGGCGAGGGCGATGCCACCTACGGCAAGCTGAC<br>CCTGAAGTTCATCTGCACCACCGGCAAGCTGCCCGTGCCCTGGCCCACCCTCGTGAC<br>CACCCTGACCTACGGCGTGCAGTGCTTCAGCCGCTACCCCGACCACATGAAGCAGCA<br>CGACTTCTTCAAGTCCGCCATGCCCGAAGGCTACGTCCAGGAGCGCACCATCTTCTT<br>CAAGGACGACGGCAACTACAAGACCCGCGCCGAGGTGAAGTTCGAGGGCGACACC<br>CTGGTGAACCGCATCGAGCTGAAGGGCATCGACTTCAAGGAGGACGGCAACATCCT<br>GGGGCACAAGCTGGAGTACAACTACAACAGCCACAACGTCTATATCATGGCCGACA<br>AGCAGAAGAACGGCATCAAGGTGAACTTCAAGATCCGCCACAACATCGAGGACGGC<br>AGCGTGCAGCTCGCCGACCACTACCAGCAGAACACCCCCATCGGCGACGGCCCCGT<br>GCTGCTGCCCGACAACCACTACCTGAGCACCCAGTCCAAGCTGAGCAAAGACCCCAA<br>CGAGAAGCGCGATCACATGGTCCTGCTGGAGTTCGTGACCGCCGCCGGGATCACTC<br>TCGGCATGGACGAGCTGTACAAatgattgtttattgcagcttataatggttacaaataaagcaatagc<br>atcacaaatttcacaaataaagcattttttcactgcattctagttgtggtttgtccaaactcatcaatgtatcttta<br>tGACATCTCGCCCGTCCTGAAGGACCCCGCCTCCTTCCGCGCCGCCATCGGCCTCCTG<br>GCGCGACACCTGAAGGCGACCCACGGGGGCCGCATCGACTACATCGCAGGCGAGT<br>GCCCAGTGGCCGCATCTAGGGCGCTTCCGCCTCTGCGCGCGCCGAGGGCAGCACGT | 1806 |

TABLE 5-continued

CONSTRUCTS USED FOR EVALUATION OF PREDICTED LOCI

| Construct name | Sequence | Length |
| --- | --- | --- |
| | GGGCTCTGCGCGTCTGCTTGGGGGAGGGCCTTTGGGGTGCTTCAGGGGGCGCCGG<br>GACGGGCGCCGTGCTTGGGTCGCCCGGGAAGGGTTGTGAGATTGAGCCCCCGAGG<br>CCGCCCGCGCTGTGCAGGCGTCCTTCCCGCAGGTTCCGGGTCCCCAGCCCAGGACAG<br>GCGTGACCGAGTTGCCGGGTCAGTTGGTCTCCCTGGAGTGCCCAAGCTGAATCCAC<br>AGGGCCCAGCTGCCTTGCTTCTTGTTCCTTCTGCGAGCTGGTATTGAGCGCCTGCCA<br>CGA (SEQ ID NO: 125) | |
| pARBI-906:<br>B2M_1_En<br>dogenous_<br>4 | AGTAATTTGATGGGGGCTATTATGAACTGAGAAATGAACTTTGAAAAGTATCTTGG<br>GGCCAAATCATGTAGACTCTTGAGTGATGTGTTAAGGAATGCTATGAGTGCTGAGA<br>GGGCATCAGAAGTCCTTGAGAGCCTCCAGAGAAAGGCTCTTAAAAATGCAGCGCAA<br>TCTCCAGTGACAGAAGATACTGCTAGAAATCTGCTAGAAAAAAAACAAAAAAGGCA<br>TGTATAGAGGAATTATGAGGGAAAGATACCAAGTCACGGTTTATTCTTCAAAATGG<br>AGGTGGCTTGTTGGGAAGGTGGAAGCTCATTTGGCCAGAGTGGAAATGGAATTGG<br>GAGAAATCGATGACCAAATGTAAACACTTGGTGCCTGATATAGCTTGACACCAAGTT<br>AGCCCCAAGTGAAATACCCTGGCAATATTAATGTGTCTTTTCCCGATATTCCTCAGGT<br>tccggatccggagagggcagggga tctctcctta cttgtggcgacgtggaggagaaccccggccccATGGT<br>GAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCA<br>CCTACGGCAAGCTGACCCTGAAGTTCATCTGCACCACCGGCAAGCTGCCCGTGCCCT<br>GGCCCACCCTCGTGACCACCCTGACCTACGGCGTGCAGTGCTTCAGCCGCTACCCCG<br>ACCACATGAAGCAGCACGACTTCTTCAAGTCCGCCATGCCCGAAGGCTACGTCCAGG<br>AGCGCACCATCTTCTTCAAGGACGACGGCAACTACAAGACCCGCGCCGAGGTGAAG<br>TTCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttttcactgcattctagttgtggtttgtcc<br>aaactcatcaatgtatcttatACTCCAAAGATTCAGGTTTACTCACGTCATCCAGCAGAGAAT<br>GGAAAGTCAAATTTCCTGAATTGCTATGTGTCTGGGTTTCATCCATCCGACATTGAA<br>GTTGACTTACTGAAGAATGGAGAGAGAATTGAAAAAGTGGAGCATTCAGACTTGTC<br>TTTCAGCAAGGACTGGTCTTTCTATCTCTTGTACTACACTGAATTCACCCCCACTGAA<br>AAAGATGAGTATGCCTGCCGTGTGAACCATGTGACTTTGTCACAGCCCAAGATAGTT<br>AAGTGGGGTAAGTCTTACATTCTTTTGTAAGCTGCTGAAAGTTGTGTATGAGTAGTC<br>ATATCATAAAGCTGCTTTGATATAAAAAAGGTCTATGGCCATACTACCCTGAATGAG<br>TCCCATCCCATCTGATATAAACAATCTGCATATTGGGATTGTCAGGGAATGTTCTTAA<br>AGATCAGA (SEQ ID NO: 126) | 1806 |
| pARBI-907:<br>B2M_2_En<br>dogenous_<br>5 | AAGATCTTAATCTTCTGGGTTTCCGTTTTCTCGAATGAAAAATGCAGGTCCGAGCAG<br>TTAACTGGCTGGGGCACCATTAGCAAGTCACTTAGCATCTCTGGGGCCAGTCTGCAA<br>AGCGAGGGGGCAGCCTTAATGTGCCTCCAGCCTGAAGTCCTAGAATGAGCGCCCGG<br>TGTCCCAAGCTGGGGCGCGCACCCCAGATCGGAGGGCGCCGATGTACAGACAGCA<br>AACTCACCCAGTCTAGTGCATGCCTTCTTAAACATCACGAGACTCTAAGAAAAGGAA<br>ACTGAAAACGGGAAAGTCCCTCTCTCTAACCTGGCACTGCGTCGCTGGCTTGGAGAC<br>AGGTGACGGTCCCTGCGGGCCTTGTCCTGATTGGCTGGGCACGCGTTTAATATAAGT<br>GGAGGCGTCGCGCTGGCGGGCATTCCTGAAGCTGACAGCATTCGGGCCAGATGTc<br>cggatccggagagggcagggga tctctcctta cttgtggcgacgtggaggagaaccccggccccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttttcactgcattctagttgtggtttgtcc<br>aaactcatcaatgtatcttatTCTCGCTCCGTGGCCTTAGCTGTGCTCGCGCTACTCTCTCTTT<br>CTGGCCTGGAGGCTATCCAGCGTGAGTCTCTCCTACCCTCCCGCTCTGGTCCTTCCTC<br>TCCCGCTCTGCACCCTCTGTGGCCCTCGCTGTGCTCTCGCTCCGTGACTTCCCTTCT<br>CCAAGTTCTCCTTGGTGGCCCGCCGTGGGGCTAGTCCAGGGCTGGATCTCGGGGAA<br>GCGGCGGGGTGGCCTGGGAGTGGGGAAGGGGGTGCGCACCCGGGACGCGCGCTA<br>CTTGCCCCTTTCGGCGGGGAGCAGGGGAGACCTTTGGCCTACGGCGACGGGAGGG<br>TCGGGACAAAGTTTAGGGCGTCGATAAGCGTCAGAGCGCCGAGGTTGGGGAGGG<br>TTTCTCTTCCGCTCTTTCGCGGGGCCTCTGGCTCCCCAGCGCAGCTGGGTGGGGG<br>ACGGGTAGGCTCG (SEQ ID NO: 127) | 1806 |
| pARBI-908:<br>B2M_3_En | AGGAATGCTATGAGTGCTGAGAGGGCATCAGAAGTCCTTGAGAGCCTCCAGAGAAA<br>GGCTCTTAAAAATGCAGCGCAATCTCCAGTGACAGAAGATACTGCTAGAAATCTGCT | 1806 |

TABLE 5-continued

CONSTRUCTS USED FOR EVALUATION OF PREDICTED LOCI

| Construct name | Sequence | Length |
| --- | --- | --- |
| dogenous_6 | AGAAAAAAAACAAAAAAGGCATGTATAGAGGAATTATGAGGGAAAGATACCAAGT<br>CACGGTTTATTCTTCAAAATGGAGGTGGCTTGTTGGGAAGGTGGAAGCTCATTTGGC<br>CAGAGTGGAAATGGAATTGGGAGAAATCGATGACCAAATGTAAACACTTGGTGCCT<br>GATATAGCTTGACACCAAGTTAGCCCCAAGTGAAATACCCTGGCAATATTAATGTGT<br>CTTTTCCCGATATTCCTCAGGTACTCCAAAGATTCAGGTTTACTCACGTCATCCAGCA<br>GAGAATGGAAAGTCAAATTTCCTGAATTGCTATGTGTCTGGGTTTCATCCATCCtccgg<br>atccggagagggcaggggatctctccttacttgtggcgacgtggaggagaaccccggccccATGGTGAGC<br>AAGGGCGAGGAGCTGTTCACCGGGGTGGTGCCCATCCTGGTCGAGCTGGACGGCG<br>ACGTAAACGGCCACAAGTTCAGCGTGTCCGGCGAGGGCGAGGGCGATGCCACCTA<br>CGGCAAGCTGACCCTGAAGTTCATCTGCACCACCGGCAAGCTGCCCGTGCCCTGGCC<br>CACCCTCGTGACCACCCTGACCTACGGCGTGCAGTGCTTCAGCCGCTACCCCGACCA<br>CATGAAGCAGCACGACTTCTTCAAGTCCGCCATGCCCGAAGGCTACGTCCAGGAGC<br>GCACCATCTTCTTCAAGGACGACGGCAACTACAAGACCCGCGCCGAGGTGAAGTTC<br>GAGGGCGACACCCTGGTGAACCGCATCGAGCTGAAGGGCATCGACTTCAAGGAGG<br>ACGGCAACATCCTGGGGCACAAGCTGGAGTACAACTACAACAGCCACAACGTCTAT<br>ATCATGGCCGACAAGCAGAAGAACGGCATCAAGGTGAACTTCAAGATCCGCCACAA<br>CATCGAGGACGGCAGCGTGCAGCTCGCCGACCACTACCAGCAGAACACCCCCATCG<br>GCGACGGCCCCGTGCTGCTGCCCGACAACCACTACCTGAGCACCCAGTCCAAGCTG<br>AGCAAAGACCCCAACGAGAAGCGCGATCACATGGTCCTGCTGGAGTTCGTGACCGC<br>CGCCGGGATCACTCTCGGCATGGACGAGCTGTACAAgattgtttattgcagcttataatggt<br>tacaaataaagcaatagcatcacaaatttcacaaataaagcatttttttcactgcattctagttgtggtttgtcca<br>aactcatcaatgtatcttatGACATTGAAGTTGACTTACTGAAGAATGGAGAGAGAATTGA<br>AAAAGTGGAGCATTCAGACTTGTCTTTCAGCAAGGACTGGTCTTTCTATCTCTTGTAC<br>TACACTGAATTCACCCCCACTGAAAAAGATGAGTATGCCTGCCGTGTGAACCATGTG<br>ACTTTGTCACAGCCCAAGATAGTTAAGTGGGGTAAGTCTTACATTCTTTTGTAAGCTG<br>CTGAAAGTTGTGTATGAGTAGTCATATCATAAAGCTGCTTTGATATAAAAAAGGTCT<br>ATGGCCATACTACCCTGAATGAGTCCCATCCCATCTGATATAAACAATCTGCATATTG<br>GGATTGTCAGGGAATGTTCTTAAAGATCAGATTAGTGGCACCTGCTGAGATACTGAT<br>GCACAGCATGGTTTCTGAACCAGTAGTTTCCCTGCAGTTGAGCAGGGAGCAGCAGC<br>AGCACTTG (SEQ ID NO: 128) | |
| pARBI-909:<br>CAPNS1_1_<br>Endo-<br>genous_7 | GATCTCACATTCTAGCGCCCAGACATGTCGGGAACGCCTTACGCCAACTTGGGGTCC<br>CCACCAAGAGAACCCCCACCAGATCTGCACCCTCCCCTTCACGCGTGCACCCAGTCC<br>AGGCTCCCTCAAGCCCCACGGGTGCCTTTTAGACCTGAGGAGGTTGCAAACCTGATC<br>CCCCATACCTGCCCCACCCATCCGCGGACAACCCGCCCTCGCAAACTCAGACCCCCAC<br>CCGGAGGCTTCAGATTCCTCCCAGGTCCAGCTGCCGGAAATGCGTGTTTGAAGGGA<br>GGGTGTGGGCTCAGGGGCGAAGCACCCACTGGTCCCCTTTTTTCCCCCCAGCAGTGA<br>GTCGCAGCCATGTTCCTGGTTAACTCGTTCTTGAAGGGCGGCGGCGGCGGCGGCGG<br>GGGAGGCGGGGCCTGGGTGGGGGCCTGGGAAATGTGCTTGGAGGCCTGATCtccg<br>gatccggagagggcaggggatctctccttacttgtggcgacgtggaggagaaccccggccccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGCC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAGC<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAgattgtttattgcagcttataatgg<br>ttacaaataaagcaatagcatcacaaatttcacaaataaagcatttttttcactgcattctagttgtggtttgtcc<br>aaactcatcaatgtatcttatAGCGGGGCCGGGGCGGCGGCGGCGGCGGCGGCGG<br>CGGCGGTGGTGGAGGCGGCGGTGGCGGTGGAACGGCCATGCGCATCCTAGGCGG<br>AGTCATCAGCGCCATCAGGTAAGGCGGAGACTATCAGAGGGGCGGGGCCTGGGAA<br>TGGGAGGAGCCTCAGTGAGGCGTGGTCTGGGAGGGGCGTGGTCTAAAAATAGAAT<br>AGGATTAACCTGGAGGCTAACCTGGGTACATGAATTAGGCCGGGGAGGCCTGGTTT<br>GAGAGTTCTGCTGTAAGGGGTGGACCCCAGTGAGGCGGATATCAGTCATTGGGG<br>GCGGTGCTTGATATGGGAGTAGTCTGATTGTGTGGGACCAGGACAATGTGGTCCTG<br>AGGGGACTGATGTGGAGTTTTGGCGGGTGGGGCTTATGGGTCTGGGCTCAGCCTG<br>CATTGGCTAACCTGGAGATGAACGTT (SEQ ID NO: 129) | 1806 |
| pARBI-910:<br>CAPNS1_2_<br>Endogenou<br>s_8 | CGGGCATTTAGGAAGCGGGCCATGGAGTAGGGTCTTGGGCAGATGGCACCTGAGG<br>AGGATAAGGCCTTGGGAAGCTGGGGCAGAGCCTCTATGAAGTGAGCCCTCCAAGG<br>GGCGGGGTCTTTTGATTCTACGTGGGATTTTTTAGGTTTAGGGTGGCCAAGATGACT<br>GAAATCTGCCACTGGGTAGGTGTGCCTGGCAGGAGGGGAGCCTCCCAGGGGACCG<br>GTCTCTGGGTTTCCTCGAGGGTGGGGTTGGCCTGAGGAAGGGAGAAGAGGGGCAC<br>GACCAGGGCAGTGTGGATTGGGACAGATGAGGACAAGAACAAATGAAAGGCACAG<br>CAACCAAGTAAGGAAGATAACGGCTGGGTCTGGAGCGTTGGGGCTGATGGTTCT<br>GTAGTGCTGCCCGTTGGAGGCCCCGCCCCTGGCACTAACCCCTCCCCCTTATCTCTTC<br>GCAGCtccggatccggagagggcaggggatctctccttacttgtggcgacgtggaggagaaccccggcccc<br>ATGGTGAGCAAGGGCGAGGAGCTGTTCACCGGGGTGGTGCCCATCCTGGTCGAGC<br>TGGACGGCGACGTAAACGGCCACAAGTTCAGCGTGTCCGGCGAGGGCGAGGGCGA | 1806 |

TABLE 5-continued

CONSTRUCTS USED FOR EVALUATION OF PREDICTED LOCI

| Construct name | Sequence | Length |
|---|---|---|
| | TGCCACCTACGGCAAGCTGACCCTGAAGTTCATCTGCACCACCGGCAAGCTGCCCGT<br>GCCCTGGCCCACCCTCGTGACCACCCTGACCTACGGCGTGCAGTGCTTCAGCCGCTA<br>CCCCGACCACATGAAGCAGCACGACTTCTTCAAGTCCGCCATGCCCGAAGGCTACGT<br>CCAGGAGCGCACCATCTTCTTCAAGGACGACGGCAACTACAAGACCCGCGCCGAGG<br>TGAAGTTCGAGGGCGACACCCTGGTGAACCGCATCGAGCTGAAGGGCATCGACTTC<br>AAGGAGGACGGCAACATCCTGGGGCACAAGCTGGAGTACAACTACAACAGCCACA<br>ACGTCTATATCATGGCCGACAAGCAGAAGAACGGCATCAAGGTGAACTTCAAGATC<br>CGCCACAACATCGAGGACGGCAGCGTGCAGCTCGCCGACCACTACCAGCAGAACAC<br>CCCCATCGGCGACGGCCCCGTGCTGCTGCCCGACAACCACTACCTGAGCACCCAGTC<br>CAAGCTGAGCAAAGACCCCAACGAGAAGCGCGATCACATGGTCCTGCTGGAGTTCG<br>TGACCGCCGCCGGGATCACTCTCGGCATGGACGAGCTGTACAAatgattgtttattgcagct<br>tataatggttacaaataaagcaatagcatcacaaatttcacaaatcaaagcatttttttcactgcattctagttgtg<br>gtttgtccaaactcatcaatgtatcttatGAGGCGGCTGCGCAGTACAACCCGGAGCCCCCGGT<br>AAGCCCCTCTGCAACCAGACCCCCTTCTCCTGCCAAGGCCTCTTCGAGGTCCCATCC<br>CTGTTCCTGTAGAGAAGCCCCACCTTCCTCCCCTTCTTGTGAAATTCCTCTGCCAGTTC<br>CTCCCATGCCGTGTCTGCAGCTTCGCCATGGGTCTTAGCCATGCCCCACATACGTGCA<br>CCCCATTCACTACCACCCCTCATTCTTTTCCTCATCAAGCTGCCCAGCCCACTCTGACT<br>TCCCCACCCAGGGTACCTGGGTTTGGGGAGCCGTCCTGGCCGGGTTCCCCTCCCCCT<br>GCTCTGAGCTCTCCTCCCTTTGCAGCCCCACGCACACATTACTCCAACATTGAGGCC<br>AACGAGAGTGAGGAGGTCCGGCAGTTCCGGAGACTCMGCCCAGCTGGCTGGAG<br>ATGTAAGTAAC (SEQ ID NO: 130) | |
| pARBI-911:<br>CAPNS1_3_<br>Endogenou<br>s_9 | GCTGATGGTTCTGTAGTGCTGCCCGTTGGAGGCCCCGCCCCTGGCACTAACCCCTCC<br>CCCTTATCTCTTCGCAGCGAGGCGGCTGCGCAGTACAACCCGGAGCCCCCGGTAAG<br>CCCCCTCTGCAACCAGACCCCCTTCTCCTGCCAAGGCCTCTTCGAGGTCCCATCCCTG<br>TTCCTGTAGAGAAGCCCCACCTTCCTCCCCTTCTTGTGAAATTCCTCTGCCAGTTCCTC<br>CATGCCGTGTCTGCAGCTTCGCCATGGGTCTTAGCCATGCCCCACATACGTGCACC<br>CCATTCACTACCACCCCTCATTCTMCCTCATCAAGCTGCCCAGCCCACTCTGACTTC<br>CCCACCCAGGGTACCTGGGTTTGGGGAGCCGTCCTGGCCGGGTTCCCCTCCCCCTGC<br>TCTGAGCTCTCCTCCCTTTGCAGCCCCACGCACACATTACTCCAACtccggatccggaga<br>gggcaggggatctctccttacttgtggcgacgtggaggagaacccggccccATGGTGAGCAAGGGCG<br>AGGAGCTGTTCACCGGGGTGGTGCCCATCCTGGTCGAGCTGGACGGCGACGTAAAC<br>GGCCACAAGTTCAGCGTGTCCGGCGAGGGCGAGGGCGATGCCACCTACGGCAAGC<br>TGACCCTGAAGTTCATCTGCACCACCGGCAAGCTGCCCGTGCCCTGGCCCACCCTCG<br>TGACCACCCTGACCTACGGCGTGCAGTGCTTCAGCCGCTACCCCGACCACATGAAGC<br>AGCACGACTTCTTCAAGTCCGCCATGCCCGAAGGCTACGTCCAGGAGCGCACCATCT<br>TCTTCAAGGACGACGGCAACTACAAGACCCGCGCCGAGGTGAAGTTCGAGGGCGA<br>CACCCTGGTGAACCGCATCGAGCTGAAGGGCATCGACTTCAAGGAGGACGGCAACA<br>TCCTGGGGCACAAGCTGGAGTACAACTACAACAGCCACAACGTCTATATCATGGCCG<br>ACAAGCAGAAGAACGGCATCAAGGTGAACTTCAAGATCCGCCACAACATCGAGGAC<br>GGCAGCGTGCAGCTCGCCGACCACTACCAGCAGAACACCCCCATCGGCGACGGCCC<br>CGTGCTGCTGCCCGACAACCACTACCTGAGCACCCAGTCCAAGCTGAGCAAAGACCC<br>CAACGAGAAGCGCGATCACATGGTCCTGCTGGAGTTCGTGACCGCCGCCGGGATCA<br>CTCTCGGCATGGACGAGCTGTACAAatgattgtttattgcagcttataatggttacaaataaagcaa<br>tagcatcacaaatttcacaaataaagcattttttcactgcattctagttgtggttttgtccaaactcatcaatgtat<br>cttatATTGAGGCCAACGAGAGTGAGGAGGTCCGGCAGTTCCGGAGACTCTTTGCCC<br>AGCTGGCTGGAGATGTAAGTAACCTGGGTCCCTGGCCCCGTCCTAACCGTTCCATC<br>CCTTCCCTTGTGGCTGCCCTTGCACACACACCCTTGACCATGACAATCCCAGTGTTCC<br>CATTCTCCATGACATTCTCAGACCCCTTTCAGTCACCCCTGACCTGCCCCTAACTTCCG<br>CCCGCAGGACATGGAGGTCAGCGCCACAGAACTCATGAACATTCTCAATAAGGTTG<br>TGACACGACGTAAGTGACCGGGGTTAAGGAATAGGGTAGATTCAGAGGCAGAGGG<br>GTCAGAGAGGATTTGACCTCTGGCCTCTGACTTTCAACCTGTTACCCACAGACCCTG<br>ATCTGAAGACTGATGGTTTTGGCATTGACACATGTCGCAGCATGGTGGCCGTGATG<br>(SEQ ID NO: 131) | 1806 |
| pARBI-912:<br>CBLB_1_En<br>dogenous_<br>10 | ggagagttatagcagatggagacaaaaaagggaactgctggggatcaaaccttgtaaagtccttctaagtgat<br>atatgaggactttgacttttattcaaagttagaaggctttgaacaaaagaattatttcatttgtgttttacaatggt<br>cacaagtgccgtagcgagaatggctgTGTAGAGAAGAGATTTTGTGGTTTCTTTTTTGTTCT<br>CTGTATTCTCTTCCTGAAAAATCTGTTTTCTGCCTAATCATATTTCTGTAAAGAACAAT<br>AGACTTGAACGTCTGCTGTTAAGTAACAAAAGGTTGACCTAAACCACATAAGGTCAGA<br>TTAACTTTTAAAATATCCAAGATAATGTTAAGTGTATTAAATATGGTTCAGTATGTAA<br>TCAAAATATTTGATATTCTCTAGATACTAATCTCttttttaattttttttattttttttAGCCTTGGtccg<br>gatccggagagggcaggggatctctccttacttgtggcgacgtggaggagaacccccggccccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG | 1806 |

TABLE 5-continued

CONSTRUCTS USED FOR EVALUATION OF PREDICTED LOCI

| Construct name | Sequence | Length |
|---|---|---|
| | CCGCCGGGATCACTCTCGGCATGGACGAGCTGTACAAatgattgtttattgcagcttataatgg<br>ttacaaataaagcaatagcatcacaaatttcacaaataaagcattttttcactgcattctagttgtggtttgtcc<br>aaactcatcaatgtatcttatGGCTCTATTTTGCGGAATTGGAATTTCTTAGCTGTGACACAT<br>CCAGGTTACATGGCCATTTCTCACATATGATGAAGTTAAAGCACGACTACAGAAATAT<br>AGCACCAAACCCGGAAGGTAAGACTTTTTAGCAGTAATATTATGTGATATATCCAAA<br>GATGAAAAATTCTCCATGGTTTGTTCCTAAGTAAGTCAGCAATACCCGCTGATGGCA<br>TGCTTGGGAGGGGGCTAGAAAAGGTAAAAGACCAAAATGGTGCTTCTTAACATAAT<br>GTTTTAAATTGATACATTGTGCTTACTCTGAAACTTGGTATTCATAAAGTGAAAGGG<br>GATATGGTCTCCTTTCTGTTTTCATGATATCCGTGTTTATGTGCAAAATTGAATGTATA<br>TATTTGAATACTTGAATACTGTGCTAAAGAACAAATAAATAGAACAGTCTTATGTTCA<br>TTACTTT (SEQ ID NO: 132) | |
| pARBI-913:<br>CBLB_2_En<br>dogenous_<br>11 | CATATTACTCATTTGTGCAATGAATAAAGGATTTCTATTATTATATGGACCCATCATCT<br>TATGACTGTTTTTAGAAAATGAGAATTAAATCTTGATTCATTATTAAATAACCTTGTA<br>TACACACATGAAGAGGTCATGACACATAAGACTTTGACCTAATACCTTTTTTCAGATA<br>TGTTTCTATAGCTATCTTGATAGCCTAGGACTGTTTGAGAGAAATTAATTTAAATTT<br>TTGTCATATTCTTAGCAAATGCAAAATAATTGAGTTAAACAGAACCCACTACATTTGT<br>TCTGAAATATGAACAATATTCTCAAATATTTGTCTGGTAGTACAAATACAATTATATT<br>AATTTTATTATTGAATTTTGCTGCTTCAAAGGGAGGTATTTCTTAAATGATACTTGATT<br>CAATTATTTCCCTTTTTTTCCACCTTGCACAGAACTATCGTAtccggatccggagagggcagg<br>ggatctctccttacttgtggcgacgtggaggagaaccccggccccATGGTGAGCAAGGGCGAGGAG<br>CTGTTCACCGGGGTGGTGCCCATCCTGGTCGAGCTGGACGGCGACGTAAACGGCCA<br>CAAGTTCAGCGTGTCCGGCGAGGGCGAGGGCGATGCCACCTACGGCAAGCTGACC<br>CTGAAGTTCATCTGCACCACCGGCAAGCTGCCCGTGCCCTGGCCCACCCTCGTGACC<br>ACCCTGACCTACGGCGTGCAGTGCTTCAGCCGCTACCCCGACCACATGAAGCAGCAC<br>GACTTCTTCAAGTCCGCCATGCCCGAAGGCTACGTCCAGGAGCGCACCATCTTCTTC<br>AAGGACGACGGCAACTACAAGACCCGCGCCGAGGTGAAGTTCGAGGGCGACACCC<br>TGGTGAACCGCATCGAGCTGAAGGGCATCGACTTCAAGGAGGACGGCAACATCCTG<br>GGGCACAAGCTGGAGTACAACTACAACAGCCACAACGTCTATATCATGGCCGACAA<br>GCAGAAGAACGGCATCAAGGTGAACTTCAAGATCCGCCACAACATCGAGGACGGCA<br>GCGTGCAGCTCGCCGACCACTACCAGCAGAACACCCCCATCGGCGACGGCCCCGTG<br>CTGCTGCCCGACAACCACTACCTGAGCACCCAGTCCAAGCTGAGCAAAGACCCCAAC<br>GAGAAGCGCGATCACATGGTCCTGCTGGAGTTCGTGACCGCCGCCGGGATCACTCT<br>CGGCATGGACGAGCTGTACAAatgattgtttattgcagcttataatggttacaaataaagcaatagca<br>tcacaaatttcacaaataaagcattttttcactgcattctagttgtggtttgtccaaactcatcaatgtatcttat<br>CCATGGAAAGTATTCAGACAGTGCCTTCATGAGGTCCACCAGATTAGCTCTGGCCTG<br>GAAGCAATGGCTCTAAAATCAACAATTGATTTAACTTGCAATGATTACATTTCAGTTT<br>TTGAATTTGATATTTTTACCAGGCTGTTTCAGGTAAGTTTATACTTGCTTAGTCTATCC<br>ATTCCCTcttctctctccctgtctttctctctgtttctctctctctgtctctctcacacacacacaTAA<br>ACAAACATATGGAAAATAGTGTCATTCCTATTAGTCTGTAATTTTATTGGTATGTTTG<br>GTCATTGTTAAAAGTTTAGAGTGAGCCATTTGGCTTAAGTTTGGAGTTATCAGATGC<br>TGTGAGCCTGGTGGCTGCTTGTTAGCTTTGAGAGGATCCATCCAAAAGAGCTTTGTT<br>TTAAACTCTCTACTTAGTTTCTTACTT (SEQ ID NO: 133) | 1806 |
| pARBI-914:<br>CBLB_3_En<br>dogenous_<br>12 | TTAAACTTTAGAGGTTCAAAATAAGGATATGATATAGAAAAGATTGAATGGTAGGAT806<br>GAACAGAATAGGATTTATTTATATTATGACAAACGTGACTATCAGTTAATAAATTGG<br>AGATAGTAAGTTAAGATCATTATTTATATTATGGAAAAATGAAGAAATAGGACATGG<br>TTCTCTAACTTTTTAATTTTTCTGTGAAATAAAATATTATGACTTATTTTATTTTTATCT<br>TTGTTTTTAGGTAAGACTGTGCCAAAATCCCAAACTTCAGTTGAAAAATAGCCCACC<br>ATATATACTTGTATATTTGCCTGATACATATCAGCATTTACGACTTATATTGAGTAAAT<br>ATGATGACAACCAGAAACTTGCCCAACTCAGTGAGAATGAGTACTTTAAAATCTACA<br>TTGATAGCCTTATGAAAAAGTCAAAACGGGCAATAAGACTCTTTAAAtccggatccggag<br>agggcaggggatctctccttacttgtggcgacgtggaggagaaccccggccccATGGTGAGCAAGGGC<br>GAGGAGCTGTTCACCGGGGTGGTGCCCATCCTGGTCGAGCTGGACGGCGACGTAA<br>ACGGCCACAAGTTCAGCGTGTCCGGCGAGGGCGAGGGCGATGCCACCTACGGCAA<br>GCTGACCCTGAAGTTCATCTGCACCACCGGCAAGCTGCCCGTGCCCTGGCCCACCCT<br>CGTGACCACCCTGACCTACGGCGTGCAGTGCTTCAGCCGCTACCCCGACCACATGAA<br>GCAGCACGACTTCTTCAAGTCCGCCATGCCCGAAGGCTACGTCCAGGAGCGCACCAT<br>CTTCTTCAAGGACGACGGCAACTACAAGACCCGCGCCGAGGTGAAGTTCGAGGGCG<br>ACACCCTGGTGAACCGCATCGAGCTGAAGGGCATCGACTTCAAGGAGGACGGCAAC<br>ATCCTGGGGCACAAGCTGGAGTACAACTACAACAGCCACAACGTCTATATCATGGCC<br>GACAAGCAGAAGAACGGCATCAAGGTGAACTTCAAGATCCGCCACAACATCGAGGA<br>CGGCAGCGTGCAGCTCGCCGACCACTACCAGCAGAACACCCCCATCGGCGACGGCC<br>CCGTGCTGCTGCCCGACAACCACTACCTGAGCACCCAGTCCAAGCTGAGCAAAGACC<br>CCAACGAGAAGCGCGATCACATGGTCCTGCTGGAGTTCGTGACCGCCGCCGGGATC<br>ACTCTCGGCATGGACGAGCTGTACAAatgattgtttattgcagcttataatggttacaaataaagcaa<br>atagcatcacaaatttcacaaataaagcattttttcactgcattctagttgtggtttgtccaaactcatcaatgta<br>tcttatGAAGGCAAGGAGAGAATGTATGAAGAACAGTCACAGGACAGGTAAGAAGAA<br>TATTTCAGATGMTGGTGTAAAGGTCATTTATGTTGCTTTTTACTTAATAGTTAACCT<br>AAACGTCACCATGTAATTGTTTTGGGGTAAATGTGAGTCGCTTTGTATATAgtcatgtgg<br>tacttaacgatggggatactttacaagaaatgcattttttagacaatttcattgttgtgtggacatgatagagtgta<br>cttacacagagctagatggtattacctaccgcacacctaggctgtatgatgtagcctattgctcctaggctgcaa<br>atctatacagtatgttactgtactgaatactgtgggcagttgtaacacaatggtaagtatgtgtgtatctaaatat<br>acctaaacatagaaaaggtatggtaaaaatactgtataaaaggccgggcgtgg (SEQ ID NO: 134) | |

TABLE 5-continued

CONSTRUCTS USED FOR EVALUATION OF PREDICTED LOCI

| Construct name | Sequence | Length |
|---|---|---|
| pARBI-915: CD2_1_Endogenous_13_14_15 | AGATGAGAAAACCTATCCTTCCCAATTTTTTTGTGTGAGAATTAAAATGCAGCAAGA AAACACACACTCATAAACACATCTGCTTTGGCAAAGGAGCACATCAGAAGGGCTGG CTTGTGCGCGCTCTTGCTCTCTGTGTATGTGTATTATGTTTTATGTTACTGTAAAAGAT GTAAAGAGAGGCACGTGGTTAAGCTCTCGGGGTGTGGACTCCACCAGTCTCACTTC AGTTCCTTTTGCATGAAGAGCTCAGAATCAAAAGAGGAAACCAACCCCTAAGATGA GCTTTCCATGTAAATTTGTAGCCAGCTTCCTTCTGATTTTCAATGTTTCTTCCAAAGGT AAGCATAAGAGTCAAAGAAGTCCCAACCCAGCTTTCCCTGAAAGTGACTCTCAGTAA CTCTTTTGCTTTTTATAGGTGCAGTCTCCAAAGAGATTACGAATGCCTTGtccggatccg gagagggcaggggatctctccttacttgtggcgacgtggaggagaaccccggccccATGGTGAGCAAG GGCGAGGAGCTGTTCACCGGGGTGGTGCCCATCCTGGTCGAGCTGGACGGCGACG TAAACGGCCACAAGTTCAGCGTGTCCGGCGAGGGCGAGGGCGATGCCACCTACGG CAAGCTGACCCTGAAGTTCATCTGCACCACCGGCAAGCTGCCCGTGCCCTGGCCCAC CCTCGTGACCACCCTGACCTACGGCGTGCAGTGCTTCAGCCGCTACCCCGACCACAT GAAGCAGCACGACTTCTTCAAGTCCGCCATGCCCGAAGGCTACGTCCAGGAGCGCA CCATCTTCTTCAAGGACGACGGCAACTACAAGACCCGCGCCGAGGTGAAGTTCGAG GGCGACACCCTGGTGAACCGCATCGAGCTGAAGGGCATCGACTTCAAGGAGGACG GCAACATCCTGGGGCACAAGCTGGAGTACAACTACAACAGCCACAACGTCTATATCA TGGCCGACAAGCAGAAGAACGGCATCAAGGTGAACTTCAAGATCCGCCACAACATC GAGGACGGCAGCGTGCAGCTCGCCGACCACTACCAGCAGAACACCCCCATCGGCGA CGGCCCCGTGCTGCTGCCCGACAACCACTACCTGAGCACCCAGTCCAAGCTGAGCAA AGACCCCAACGAGAAGCGCGATCACATGGTCCTGCTGGAGTTCGTGACCGCCGCCG GGATCACTCTCGGCATGGACGAGCTGTACAAatgattgttttattgcagcttataatggttacaaat aaagcaatagcatcacaaatttcacaaataaagcattttttttcactgcattctagttgtggtttgtccaaactcat caatgtatcttatGAAACCTGGGGTGCCTTGGGTCAGGACATCAACTTGGACATTCCTAG TTTTCAAATGAGTGATGATATTGACGATATAAAATGGGAAAAAACTTCAGACAAGAA AAAGATTGCACAATTCAGAAAAGAGAAAGAGACTTTCAAGGAAAAAGATACATATA AGCTATTTAAAAATGGAACTCTGAAAATTAAGCATCTGAAGACCGATGATCAGGATA TCTACAAGGTATCAATATATGATACAAAAGGAAAAAATGTGTTGGAAAAAATATTTG ATTTGAAGATTCAAGGTAAGTGTTCATTCCCTTAATTGCTTTATTTCAGTGTGGGTGC TATTTGGCAAGTTGGAAAATAGCATTTCTAATATTCCCCAGCGCTGACCTCTGCCTCC AGGGGGGCTATACAGGAAACCAGATGCATGTCTCCTGCCCCAGTGGAGACTGTGGT CCAA (SEQ ID NO: 135) | 1806 |
| pARBI-916: CD3E_1_Endogenous_16 | AGGATTGTTCTAGTTGATTGGTATGTGTGCACTCCTAGTTGTTAAATATTTTCACTAT CACACCTGGATATACTCAACAAATATTTGTTGAGCCAAATACTCAACACCAGCCAAA CACGTAGTATTTACTTTAGCTTAAGCGAATTATTTAGCCCTGACAGAAGCCCTGGAAT GTGGGTCTTTAAGTTCCTATTTTTGAGATGGGAAAGCTGAGGCTCACGGAAGGAGG TGACCAGCTCAAGTCTCCTACCGTCCATGCCAAATTAGAATTCCAGCCTGCCTCCTGA CTTCAAGTCCAAAGTTCTTCCCACGCACTAAAGCTAGCTCTTCAGTGTCCTTTCTTAG GAGGTACTTCCTCCCGCACCACTGACCGCCCCCTCTCTATTTCACCCCCAGCCCATCC GGAAAGGCCAGCGGGACCTGTATTCTGGCCTGAATCAGAGACGGCATCtccggatccgga gagggcaggggatctctccttacttgtggcgacgtggaggagaaccccggccccATGGTGAGCAAGGG CGAGGAGCTGTTCACCGGGGTGGTGCCCATCCTGGTCGAGCTGGACGGCGACGTAA ACGGCCACAAGTTCAGCGTGTCCGGCGAGGGCGAGGGCGATGCCACCTACGGCAA GCTGACCCTGAAGTTCATCTGCACCACCGGCAAGCTGCCCGTGCCCTGGCCCACCCT CGTGACCACCCTGACCTACGGCGTGCAGTGCTTCAGCCGCTACCCCGACCACATGAA GCAGCACGACTTCTTCAAGTCCGCCATGCCCGAAGGCTACGTCCAGGAGCGCACCAT CTTCTTCAAGGACGACGGCAACTACAAGACCCGCGCCGAGGTGAAGTTCGAGGGCG ACACCCTGGTGAACCGCATCGAGCTGAAGGGCATCGACTTCAAGGAGGACGGCAAC ATCCTGGGGCACAAGCTGGAGTACAACTACAACAGCCACAACGTCTATATCATGGCC GACAAGCAGAAGAACGGCATCAAGGTGAACTTCAAGATCCGCCACAACATCGAGGA CGGCAGCGTGCAGCTCGCCGACCACTACCAGCAGAACACCCCCATCGGCGACGGCC CCGTGCTGCTGCCCGACAACCACTACCTGAGCACCCAGTCCAAGCTGAGCAAAGACC CCAACGAGAAGCGCGATCACATGGTCCTGCTGGAGTTCGTGACCGCCGCCGGGATC ACTCTCGGCATGGACGAGCTGTACAAatgattgttttattgcagcttataatggttacaaataaagca atagcatcacaaatttcacaaataaagcattttttttcactgcattctagttgtggtttgtccaaactcatcaatgta tcttatTGACCCTCTGGAGAACACTCCTCCCGCTGGCCCAGGTCTCCTCTCCAGTCCCC CTGCGACTCCCTGTTTCCTGGGCTAGTCTTGGACCCCACGAGAGAGAATCGTTCCTC AGCCTCATGGTGAACTCGCGCCCTCCAGCCTGATCCCCCGCTCCCTCCTCCCTGCCTT CTCTGCTGGTACCCAGTCCTAAAATATTGCTGCTTCCTCTTCCTTTGAAGCATCATCAG TAGTCACACCCTCACAGCTGGCCTGCCCTCTTGCCAGGATATTTATTTGTGCTATTCA CTCCCTTCCCTTTGGATGTAACTTCTCCGTTCAGTTCCCTCCTTTTCTTGCATGTAAGTT GTCCCCCATCCCAAAGTATTCCATCTACTTTTCTATCGCCGTCCCCTTTTGCAGCCCTC TCTGGGGATGGACTGGGTAAATGTTGACAGAGGCCCTGCCCCGTT (SEQ ID NO: 136) | 1806 |
| pARBI-917: CD3E_2_Endogenous_17_18 | AATAATAAAATAATAACAATACTTAACATTTATTGAGTGCTTATTAAGTCTCAAGCAC TGTCTGTACCCAACACTTATCAAGGATTCTTTTTCATGTAATCCTCTCAACAACTATAT GGGTTAAGTATCATTTTATTCCCATGAGTAAAGGGATGAGGAAACAGAGGGGT GAGTTGAAAACACATTTCACGCTTCTCACAGCTAGTGAGTAATAAAGCTGGGACTCA AACCCAGGGCTGTTTGACTCCAGTGCCTCTACCCACGGCCACCACTCTTTGCTTGTCA ATGTTGTTCTAAACATATTGAAGGGGGGCTCTGACCGTGGCAAGCGTGTGAGTAG TAAGGGGAGAATGGCCTTCATGCACTCCCTCCTCACCTCCAGCGCCTTGTGTTTTCCT TGCTTAGTGATTTCCCCTCTCCCACCCCACCCCCCACAGTGTGTGAGtccggatccggag agggcaggggatctctccttacttgtggcgacgtggaggagaaccccggccccATGGTGAGCAAGGGC | 1806 |

TABLE 5-continued

CONSTRUCTS USED FOR EVALUATION OF PREDICTED LOCI

| Construct name | Sequence | Length |
|---|---|---|
| | GAGGAGCTGTTCACCGGGGTGGTGCCCATCCTGGTCGAGCTGGACGGCGACGTAA<br>ACGGCCACAAGTTCAGCGTGTCCGGCGAGGGCGAGGGCGATGCCACCTACGGCAA<br>GCTGACCCTGAAGTTCATCTGCACCACCGGCAAGCTGCCCGTGCCCTGGCCCACCCT<br>CGTGACCACCCTGACCTACGGCGTGCAGTGCTTCAGCCGCTACCCCGACCACATGAA<br>GCAGCACGACTTCTTCAAGTCCGCCATGCCCGAAGGCTACGTCCAGGAGCGCACCAT<br>CTTCTTCAAGGACGACGGCAACTACAAGACCCGCGCCGAGGTGAAGTTCGAGGGCG<br>ACACCCTGGTGAACCGCATCGAGCTGAAGGGCATCGACTTCAAGGAGGACGGCAAC<br>ATCCTGGGGCACAAGCTGGAGTACAACTACAACAGCCACAACGTCTATATCATGGCC<br>GACAAGCAGAAGAACGGCATCAAGGTGAACTTCAAGATCCGCCACAACATCGAGGA<br>CGGCAGCGTGCAGCTCGCCGACCACTACCAGCAGAACACCCCCATCGGCGACGGCC<br>CCGTGCTGCTGCCCGACAACCACTACCTGAGCACCCAGTCCAAGCTGAGCAAAGACC<br>CCAACGAGAAGCGCGATCACATGGTCCTGCTGGAGTTCGTGACCGCCGCGGGATC<br>ACTCTCGGCATGGACGAGCTGTACAAatgattgtttattgcagcttataatggttacaaataaagca<br>atagcatcacaaatttcacaaataaagcattttttcactgcattctagttgtggtttgtccaaactcatcaatgta<br>tcttatAACTGCATGGAGATGGATGTGATGTCGGTGGCCACAATTGTCATAGTGGACA<br>TCTGCATCACTGGGGGCTTGCTGCTGCTGGTTTACTACTGGGCAAGAATAGAAAG<br>GCCAAGGCCAAGCCTGTGACACGAGGAGCGGGTGCTGGCGGCAGGCAAAGGGGT<br>AAGGCTGTGGAGTCCAGTCAGAGGAGATTCCTGCCAAGGGGGACGACCAGCCTGG<br>GCCAGGGTGGGTGGCAAGTCCACAGCTAGGTCAGAACAGCTTCTCTAGAGCTTCTA<br>TGCACAGCTTCTATTACTGTGATGACAAGATCTCAACAGACGTTTCAAATCTCACAT<br>CACTCCCCTCCTTCCCATCCTAGAAAAGTGCAAAAAGTTTATGAAAGTGATGGGCT<br>TCCTCACATACCTGTCAATGCCTGCAGTCATCCGATTCCGCCCCTAAGCTGTGGGAA<br>GAGAG (SEQ ID NO: 137) | |
| pARBI-918:<br>CD3G_LEn<br>ogenous_<br>19_20 | ACTGTGACCCATGAACCAGTAGGTATTGGCGTCACCTGGGATCCTGACGTTAGTCTC<br>TGTCAATCCTTCTCTTTAGTTCATCTATTCTACCCAAAGTGATCTCATCATCTGGTATG<br>CTGTTAGCAGTTTCTTACCTGTATAGTATCTTCCAAATAACATGCCCCAAAATCCCAA<br>AGTTTTACCCCTACTAATTACAGCAATGTCTCTTTTATTCTTCACCCCCTGACGCAGAT<br>ATTGGCGTCACCCGAGAGCATGTTAGTAATGCAGAATCTCCCCTCCCCAGAACTACT<br>AAATAGCACCTGAAATTTTAACAAGATCCCCATGTGATTCATGTGCACATCAAAGTTT<br>GAGAAACACTACTCTAATGATCTCCTGGTATGCAGAAGCAGGGAGAATTTCAGAGG<br>CAAGATCCTTAATAGAACCACGGCTTTTCTCATTTCAGGAAACCACtccggatccggagag<br>ggcagggggatctctccttacttgtggcgacgtggaggagaaccccggccccATGGTGAGCAAGGGCG<br>AGGAGCTGTTCACCGGGGTGGTGCCCATCCTGGTCGAGCTGGACGGCGACGTAAAC<br>GGCCACAAGTTCAGCGTGTCCGGCGAGGGCGAGGGCGATGCCACCTACGGCAAGC<br>TGACCCTGAAGTTCATCTGCACCACCGGCAAGCTGCCCGTGCCCTGGCCCACCCTCG<br>TGACCACCCTGACCTACGGCGTGCAGTGCTTCAGCCGCTACCCCGACCACATGAAGC<br>AGCACGACTTCTTCAAGTCCGCCATGCCCGAAGGCTACGTCCAGGAGCGCACCATCT<br>TCTTCAAGGACGACGGCAACTACAAGACCCGCGCCGAGGTGAAGTTCGAGGGCGA<br>CACCCTGGTGAACCGCATCGAGCTGAAGGGCATCGACTTCAAGGAGGACGGCAACA<br>TCCTGGGGCACAAGCTGGAGTACAACTACAACAGCCACAACGTCTATATCATGGCCG<br>ACAAGCAGAAGAACGGCATCAAGGTGAACTTCAAGATCCGCCACAACATCGAGGAC<br>GGCAGCGTGCAGCTCGCCGACCACTACCAGCAGAACACCCCCATCGGCGACGGCCC<br>CGTGCTGCTGCCCGACAACCACTACCTGAGCACCCAGTCCAAGCTGAGCAAAGACCC<br>CAACGAGAAGCGCGATCACATGGTCCTGCTGGAGTTCGTGACCGCCGCCGGGATCA<br>CTCTCGGCATGGACGAGCTGTACAAatgattgtttattgcagcttataatggttacaaataaagcaa<br>tagcatcacaaatttcacaaataaagcattttttcactgcattctagttgtggtttgtccaaactcatcaatgtat<br>cttatTTGGTTAAGGTGTATGACTATCAAGAAGATGGTTCGGTACTTCTGACTTGTGAT<br>GCAGAAGCCAAAAATATCACATGGTTTAAAGATGGGAAGATGATCGGCTTCCTAAC<br>TGAAGATaaaaaaaaaTGGAATCTGGGAAGTAATGCCAAGGACCCTCGAGGGATGTA<br>TCAGTGTAAAGGATCACAGAACAAGTCAAAACCACTCCAAGTGTATTACAGAAGTAT<br>GTAATCCCCTTTGGTCTGTTTGTTGTGAAATTAATCAGTATTTGCTGTTCTGGTGAGC<br>TTTTTATCTGGGGTGAAAGTGGAAATAGATCCTCAACAGTAATATTATCGCCTGTTCT<br>CTTAAATTTCAGCTTGCCTCTTTTAAAATACTGTAAGATACTTCCCTCACCCTATTGAAA<br>AACTACAGCCAGTCCTGTAAAATTTTGTTTTACCTTTGGGTGGGCTCCATGG (SEQ ID<br>NO: 138) | 1806 |
| pARBI-919:<br>CD3G_3_En<br>dogenous_<br>21 | TTCGAGACAAGCCTGGCCAACATGATGAAACTCTGTCTCTACTAAAAATACAAAAAA<br>AATTAACCAGGCGTGGAGGCGCGCGCCTGTAGTCCCAGCTACTCAGGAGGCTGAGG<br>CAGGAGGACCACTTGAACCCAGGAGGTCGAGGTTGCAGTGAGCTGCGATTGTGCCA<br>CTGCACTCCAGCCTGGGCAACAGAGAAAGACTCCGTCTCAAAAAAAAAAAAGAGAG<br>AGAGAGAAAAGAAAAAAGACAGAGCCTCCATCTCCTTGTCCTCMCCATCCTCAG<br>GACCATGAAGTACCCACTCCAAATTCTCACATATAAAAAACATTCAATAAACATGCAT<br>CAAATTAATTAATAGAGGATGGAAAAAATGACTTATGACTGTGCTGTCCTTTCCAGC<br>CCCTCAAGGATCGAGAAGATGACCAGTACAGCCACCTTCAAGGAAACCAGTTGtccg<br>gatccggagagggcagggggatctctccttacttgtggcgacgtggaggagaaccccggccccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAGCTGGAGTACAACTACAACAGCCACAACGTCTA<br>TATCATGGCCGACAAGCAGAAGAACGGCATCAAGGTGAACTTCAAGATCCGCCACA | 1806 |

TABLE 5-continued

CONSTRUCTS USED FOR EVALUATION OF PREDICTED LOCI

| Construct name | Sequence | Length |
|---|---|---|
| | ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatAGGAGGAATTGAACTCAGGACTCAGAGTAGGTGGGTTCTTC<br>AATGCCAATTCTAATAAAGGACCCTTGCATCAACTGCCCTCGCAATTGCTTCTAAGTC<br>TAGCTCCCTTCCCTAAGCGGCTATAAGCATCAGACTCTGGGGATCAGGGATTGGGAC<br>GTGGTTTGGGGTACTCTTTTCTAAAAATTCTGGGGCCATACTGATTGTCTTGGCCTAG<br>GTAAATATGAATTTTATGTATCTGTAAATCCTGTCAGAGCAGGGCCTCAAGCCATAG<br>AGATGCTGAATATTAATCTTAACCTACATTTGAATTTCTCATTATCTACACTATTAACA<br>TTTTGGGCTAATTAATTATTTGTGATGAGGGGCTAGCCTGTGCATTGTAGGAGTTAT<br>GGAAGCATCCCTGGCCTCTCTCCACCAGATGCTGGTAGATTGTCCAGTGTGACAATC<br>AAAAAT (SEQ ID NO: 139) | |
| pARBI-920:<br>CD5_1_End<br>ogenous_2<br>2 | GACCTCAGGTGATCTGCCCGCCTCAGCTTCCCAAAGTGCTGGGATTACAGGCATGAG<br>CCACCACACCTGGCCTAAAATTAATTTTTAAAGATCTCTTAAAAAGCAGACACCAGCC<br>CCAATCTCAGACCCCTTGAGACAGAATTTTCAGGACAGGGGCCATCCTGCTGGACA<br>GTGGGTGCCGAGAACACCTTGCCCATTTATCTGAGCTCCCTTCTGACTCTGAAATCTG<br>GAGCCCCACCCTCCTGGGTCTAGCTTCGGGGCTGCCTGGGTCAGGGTCCTCTGGGA<br>AGCCCCTGCAGTGCCCCAGAAGGGACGAAGCTCACAAGGGGCAAGGCAGGCAGCC<br>CACGGGGCAGGAGGGAGCTCAACTGGGCGTCCTAGGGAGAGGGCAGTGAGGGGT<br>GCCAGTGGGGAACCCCTCCCAGCCTGACCCCCACCACACCTTTCTGACCCCCAGATtc<br>cggatccggagagggcaggggatctctccttacttgtggcgacgtggaggagaaccccggccccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatTTCCAGGCAAGGCTCACCCGTTCCAACTCGAAGTGCCAGGG<br>CCAGCTGGAGGTCTACCTCAAGGACGGATGGCACATGGTTTGCAGCCAGAGCTGGG<br>GCCGGAGCTCCAAGCAGTGGGAGGACCCCAGTCAAGCGTCAAAAGTCTGCCAGCG<br>GCTGAACTGTGGGGTGCCCTTAAGCCTTGGCCCCTTCCTTGTCACCTACACACCTCAG<br>AGCTCAATCATCTGCTACGGACAACTGGGCTCCTTCTCCAACTGCAGCCACAGCAGA<br>AATGACATGTGTCACTCTCTGGGCCTGACCTGCTTAGGTGGGTAACTAGCCAGCCAC<br>ACGGGCACCCTGGGCCTGGGCGCCAGCCCCGAGGAGACTGCCCGAGGCCTGTGAT<br>CTAGGGTCTGAGCAGGCTGGTGGAAGGGGTGGGGGGACCCCAGTTTATAACCACT<br>CCCCAAGACACATACC (SEQ ID NO: 140) | 1806 |
| pARBI-921:<br>CD5_2_End<br>ogenous_2<br>3 | GGACAGGGGCCATCCTGCTGGACAGTGGGTGCCGAGAACACCTTGCCCATTTATCT<br>GAGCTCCCTTCTGACTCTGAAATCTGGAGCCCCACCCTCCTGGGTCTAGCTTCGGGG<br>CTGCCTGGGTCAGGGTCCTCTGGGAAGCCCCTGCAGTGCCCCAGAAGGGACGAAGC<br>TCACAAGGGGCAAGGCAGGCAGCCCACGGGGCAGGAGGGAGCTCAACTGGGCGT<br>CCTAGGGAGAGGGCAGTGAGGGGTGCCAGTGGGGAACCCCTCCCAGCCTGACCCC<br>CACCACACCTTTCTGACCCCCAGATTTCCAGGCAAGGCTCACCCGTTCCAACTCGAAG<br>TGCCAGGGCCAGCTGGAGGTCTACCTCAAGGACGGATGGCACATGGTTTGCAGCCA<br>GAGCTGGGGCCGGAGCTCCAAGCAGTGGGAGGACCCCAGTCAAGCGTCAAAAGTC<br>TGCtccggatccggagagggcaggggatctctccttacttgtggcgacgtggaggagaaccccggccccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcatttttttcactgcattctagttgtggtt<br>tgtccaaactcatcaatgtatcttatCAGCGGCTGAACTGTGGGGTGCCCTTAAGCCTTGGCC<br>CCTTCCTTGTCACCTACACACCTCAGAGCTCAATCATCTGCTACGGACAACTGGGCTC<br>CTTCTCCAACTGCAGCCACAGCAGAAATGACATGTGTCACTCTCTGGGCCTGACCTG<br>CTTAGGTGGGTAACTAGCCAGCCACACGGGCACCCTGGGCCTGGGCGCCAGCCCCG | 1806 |

TABLE 5-continued

CONSTRUCTS USED FOR EVALUATION OF PREDICTED LOCI

| Construct name | Sequence | Length |
|---|---|---|
| | AGGAGACTGCCCGAGGCCTGTGATCTAGGGTCTGAGCAGGCTGGTGGAAGGGGTG<br>GGGGGACCCCAGTTTATAACCACTCCCCAAGACACATACCCAGGAGGGGGACTGGA<br>AGGGGCCAGCACCCATCTGTAGGATGGCAATGGAGGACCTAGTTCTGCCAATCACT<br>GACTTCATCGTCGCCTCTGAACCTCCATTCTCCCATCTGTGAAGTGGGGTGGTACTTC<br>CCGCCTCGCAGGAGGCT (SEQ ID NO: 141) | |
| pARBI-922:<br>CD5_3_End<br>ogenous_2<br>4 | tgctgggattacaggcatgagccaccacacctggcctaaaattaattttttaaagaTCTCTTAAAAAGCAG<br>ACACCAGCCCCAATCTCAGACCCCTTGAGACAGAATTTCCAGGACAGGGGCCATCCT<br>GCTGGACAGTGGGTGCCGAGAACACCTTGCCCATTTATCTGAGCTCCCTTCTGACTC<br>TGAAATCTGGAGCCCCACCCTCCTGGGTCTAGCTTCGGGGCTGCCTGGGTCAGGGTC<br>CTCTGGGAAGCCCCTGCAGTGCCCCAGAAGGGACGAAGCTCACAAGGGGCAAGGC<br>AGGCAGCCCACGGGGCAGGAGGGAGCTCAACTGGGCGTCTAGGGGAGAGGGCAG<br>TGAGGGGTGCCAGTGGGGAACCCCTCCCAGCCTGACCCCCACCACACCTTTCTGACC<br>CCCAGATTTCCAGGCAAGGCTCACCCGTTCCAACTCGAAGTGCtccggatccggagagggc<br>aggggatctctccttacttgtggcgacgtggaggagaaccccggccccATGGTGAGCAAGGGCGAGG<br>AGCTGTTCACCGGGGTGGTGCCCATCCTGGTCGGAGCGGCGACGTAAACGGC<br>CACAAGTTCAGCGTGTCCGGCGAGGGCGAGGGCGATGCCACCTACGGCAAGCTGA<br>CCCTGAAGTTCATCTGCACCACCGGCAAGCTGCCCGTGCCCTGGCCCACCCTCGTGA<br>CCACCCTGACCTACGGCGTGCAGTGCTTCAGCCGCTACCCCGACCACATGAAGCAGC<br>ACGACTTCTTCAAGTCCGCCATGCCCGAAGGCTACGTCCAGGAGCGCACCATCTTCT<br>TCAAGGACGACGGCAACTACAAGACCCGCGCCGAGGTGAAGTTCGAGGGCGACAC<br>CCTGGTGAACCGCATCGAGCTGAAGGGCATCGACTTCAAGGAGGACGGCAACATCC<br>TGGGGCACAAGCTGGAGTACAACTACAACAGCCACAACGTCTATATCATGGCCGAC<br>AAGCAGAAGAACGGCATCAAGGTGAACTTCAAGATCCGCCACAACATCGAGGACG<br>GCAGCGTGCAGCTCGCCGACCACTACCAGCAGAACACCCCCATCGGCGACGGCCCC<br>GTGCTGCTGCCCGACAACCACTACCTGAGCACCCAGTCCAAGCTGAGCAAAGACCCC<br>AACGAGAAGCGCGATCACATGGTCCTGCTGGAGTTCGTGACCGCCGCCGGGATCAC<br>TCTCGGCATGGACGAGCTGTACAAatgattgtttattgcagcttataatggttacaaataaagcaat<br>agcatcacaaatttcacaaataaagcatttttttcactgcattctagttgtggtttgtccaaactcatcaatgtatc<br>ttatCAGGGACCAGCTGGAGGTCTACCTCAAGGACGGATGGCACATGTTTGCAGCCA<br>GAGCTGGGGCCGGAGCTCCAAGCAGTGGGAGGACCCCAGTCAAGCGTCAAAAGTC<br>TGCCAGCGGCTGAACTGTGGGGTGCCCTTAAGCTTGGCCCCTTCCTTGTCACCTAC<br>ACACCTCAGAGCTCAATCATCTGCTACGGACAACTGGGCTCCTTCTCCAACTGCAG<br>CACAGCAGAAATGACATGTGTCACTCTCTGGGCCTGACCTGCTTAGGTGGGTAACTA<br>GCCAGCCACACGGGCACCCTGGGCCTGGGCGCCAGCCCCGAGGAGACTGCCCGAG<br>GCCTGTGATCTAGGGTCTGAGCAGGCTGGTGGAAGGGGTGGGGGGGACCCCAGTTT<br>ATAACCACTCCCCAAGACACATACCCAGGAGGGGGACTGGAAGGGGCCAGCACCCA<br>TCTGT (SEQ ID NO: 142) | 1806 |
| pARBI-923:<br>EDF1_1_En<br>dogenous_<br>25 | GGGGGCGGCCGCACGGCTAGAGCGGAGACCCCGCGCCCCCTCCGCCCGCGTGGCC<br>CGGCCGGGGTGCGGGGCCCGGGGAGGCACGGGGGCTGCCGTCGGGGCGCAGCC<br>GCCGCCCGCGTGTGCTCGGAGGCCGCGGGGCCCGGGCTCCGGGGTCCTCCCGACCT<br>GCAGCCCCAGCGGCTACCGCGCCTCGCCAGGCCAGGCCAGGCCCCGACGTCGCCTT<br>CCCTACGTCGCCGGCGCCCGGCCACGACGTCCCTCAGACGAGCCGAACGCCGAATG<br>GCCCCGAGCACGGGAAGTGCCCGCCCCCGCGTGCAGCCAGCCAATGGGACGCCG<br>AAAGCGGGGAGGTGCCGAGGGGACGTAGCGTCGCCGCGCCAGGTCTCTAGCAGCT<br>GCCGCTGAGCCGCCGGACGGACGCTCGTCTTCGCCCGCCATGCCGAGAGCGACTG<br>GGACACGtccggatccggagagggcaggggatctctccttacttgtggcgacgtggaggagaaccccggc<br>cccATGGTGAGCAAGGGCGAGGAGCTGTTCACCGGGGTGGTGCCCATCCTGGTCGA<br>GCTGGACGGCGACGTAAACGGCCACAAGTTCAGCGTGTCCGGCGAGGGCGAGGGC<br>GATGCCACCTACGGCAAGCTGACCCTGAAGTTCATCTGCACCACCGGCAAGCTGCCC<br>GTGCCCTGGCCCACCCTCGTGACCACCCTGACCTACGGCGTGCAGTGCTTCAGCCGC<br>TACCCCGACCACATGAAGCAGCACGACTTCTTCAAGTCCGCCATGCCCGAAGGCTAC<br>GTCCAGGAGCGCACCATCTTCTTCAAGGACGACGGCAACTACAAGACCCGCGCCGA<br>GGTGAAGTTCGAGGGCGACACCCTGGTGAACCGCATCGAGCTGAAGGGCATCGAC<br>TTCAAGGAGGACGGCAACATCCTGGGGCACAAGCTGGAGTACAACTACAACAGCCA<br>CAACGTCTATATCATGGCCGACAAGCAGAAGAACGGCATCAAGGTGAACTTCAAGA<br>TCCGCCACAACATCGAGGACGGCAGCGTGCAGCTCGCCGACCACTACCAGCAGAAC<br>ACCCCCATCGGCGACGGCCCCGTGCTGCTGCCCGACAACCACTACCTGAGCACCCAG<br>TCCAAGCTGAGCAAAGACCCCAACGAGAAGCGCGATCACATGGTCCTGCTGGAGTT<br>CGTGACCGCCGCCGGGATCACTCTCGGCATGGACGAGCTGTACAAatgattgtttattgca<br>gcttataatggttacaaataaagcaatagcatcacaaatttcacaaataaagcatttttttcactgcattctagtt<br>gtggtttgtccaaactcatcaatgtatcttatGTGACGGTGCTGCGCAAGAAGGGCCTACGGC<br>CGCCCAGGCCAAATCCAAGCAGGTGCTTTGCTGACTGAGGAGCGGCCGGGCCGGG<br>CGGGGCGGACGCTggccggggccacggaccgtggggcaggggctcggggaagggcaggcggggc<br>ctgggacagggcgcaggggacggggacaaggctggGGTGCCGGGGGCAGGACGGGGTTCGAA<br>GGGCGGGGCGAATCGCAGGGGTAGGAGGACGGGCCAGGACAgggggtgggaaggtgg<br>gggcggaccaggaggggatgacggacccaggaggcaggggCGGGCGACTGGAGGAGGAG<br>AGGAGCAGGGAACCGGACGGGGCAAGGGGCAGGCGATAGGGCCGGGACCAGTGC<br>CAGGGTGGGGCGGGAGGGGATAGGGCAGGGACTGTTGGTGGGGACAGGTGT<br>GAGGACAG (SEQ ID NO: 143) | 1806 |
| pARBI-924:<br>EDF1_2_En<br>dogenous_ | ACGGCTAGAGCGGAGACCCCGCGCCCCCTCCGCCCGCGTGGCCCGGCCGGGGTGC<br>GGGGCCCGGGGAGGCACGGGGGCTGCGCGTCGGGGCGCAGCCGCCGCCCGCGTG<br>TGCTCGGAGGCCGCGGGGCCCGGGCTCCGGGGTCCTCCCGACCTGCAGCCCCAGCG | 1806 |

TABLE 5-continued

CONSTRUCTS USED FOR EVALUATION OF PREDICTED LOCI

| Construct name | Sequence | Length |
|---|---|---|
| 26 | GCTACCGCGCCTCGCCAGGCCAGGCCAGGCCCCGACGTCGCCTTCCCTACGTCGCCG<br>GCGCCCGGCCACGACGTCCCTCAGACGAGCCGAACGCCGAATGGCCCCGAGCACG<br>GGAAGTGCCCGCCCCCCGCGTGCAGCCAGCCAATGGGACGCCGAAAGCGGGGAGG<br>TGCCGAGGGGACGTAGCGTCGCCGCGCCAGGTCTCTAGCAGCTGCCGCTGAGCCGC<br>CGGACGGACGCTCGTCTTCGCCCGCCATGGCCGAGAGCGACTGGGACACGGTGAC<br>GGTGCTGtccggatccggagagggcaggggatctctccttacttgtggcgacgtggaggagaacccggcc<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcatttttttcactgcattctagttg<br>tggtttgtccaaactcatcaatgtatcttatCGCAAGAAGGGCCCTACGGCCGCCCAGGCCAAA<br>TCCAAGCAGGTGCTTTGCTGACTGAGGAGCGGCCGGGCGGGCGGGGCGGACGCT<br>gggccggggccacggaccgtggggcaggggctcggggaagggcaggcgggggcctgggacagggcgcagg<br>ggacggggacaaggctggGGTGCCGGGGGCAGGACGGGGTTCGAAGGGCGGGGCGAAT<br>CGCAGGGGTAGGAGGACCGGGCCAGGACagggggtgggaaggtgggggggcggacccaggagg<br>ggatgggacggacccaggaggcaggggCGGGCGACTGGAGGAGGAGGAGCAGGGAAC<br>CGGACGGGCAAGGGCAGGCGATAGGGCCGGGACCAGTGCCAGGGTGGGGCG<br>GGGAGGGGATAGGGGCAGGGACTGTTGGTGGGGACAGGTGTGAGGACAGAGGCA<br>GGAGGTG (SEQ ID NO: 144) | |
| pARBI-925:<br>EDF1_3_En<br>dogenous_<br>27 | CCCTGGAGTCGGTGTGAGGCAAAAGCAGAGGAGAGGATTTGGAATTAACCTGAAG<br>AAAAACCATTTCAAAGCGGTAACCAGACCCCAGAGGCTGCCTGAACTCAAGGGGAC<br>ATGGGAACCCAGGCTGTCCCAAGTTCACACACCTCAGGTCGTGGACTTCCAGAGTTT<br>TCTCTCAGTTATGAGGACAGGCAGCTGTACTCATGCCAACCAGAGCTGCTCTGGGAA<br>GATGGCTGCCTCCCAGGGCTCCGGCCAGCACCGGTGCAGGCAGGCACTCAGCTGAC<br>AACGTCCCCGGGGGCGCCGCACACACCACACCCACCAGCACATGGACCCCACAGCA<br>CAGCCTCATGTTGCAAGCGGAAACACAAGTACCTACATTTCTTGGAAGTCTCCACAT<br>CTTCTCCTCGTCTCTGTGCCGCTAAGATAGCCTAGAAAATTAGAAAACATCAGTGGtc<br>cggatccggagagggcaggggatctctccttacttgtggcgacgtggaggagaacccggccccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatTTTCTAAAGAGAAGATGTGCTTTATACACATCAGCTCCACTA<br>GGACTGCTGCAAAACCAGGCGCGAAGCGTCGCCTGAGAACAGCAGCTTCTAGGGCC<br>CCTGGGGTACGCACCCACACGCAGCTGGGTTTTGTGCGAGAGGCAGTGAGAGCCG<br>GGCTGACCTGGCTTCCCGAGGCATTCCCTGCAGGGGAACCAGGGGGGTGGAGCCC<br>ACCCCTCCCCGTGCTATCTGAACACCGGCCATCCCCCTCCCCAAACCCACAACCCCAGG<br>AGTGAGAGCCCCGGCGCAGCCTCACCGTGGCCAGGTCCTTCTGCGTAAGCCCCTTGC<br>TCTGCCGACCTTGCTGGATCACCTTGCCCACCTTCCAGGGTCACCCTGTCATGGTGCA<br>GCTCCTCTGTCTCCCGGTCCAGCTTGGCCGTGTTCTTGGTAATAGAATGTTGTTTGTT<br>CTGGCCAGCAGC (SEQ ID NO: 145) | 1806 |
| pARBI-926:<br>FTL_1_Endo<br>genous_28_<br>30 | CTCTTGCTTCAACAGTGTTTGGACGGAACAGATCCGGGGACTCTCTTCCAGCCTCCG<br>ACCGCCCTCCGATTTCCTCTCCGCTTGCAACCTCCGGGACCATCTTCTCGGCCATCTCC<br>TGCTTCTGGGACCTGCCAGCACCGTTTTTGTGGTTAGCTCCTTGCCAACCAACCA<br>TGAGCTCCCAGATTCGTCAGAATTATTCCACCGACGTGGAGGCAGCCGTCAACAGCC<br>TGGTCAATTTGTACCTGCAGGCCTCCTACACCTACCTCTCTCTGGTGAGTCCCCAGGA<br>CGCCCCTGGCCCTAATTTCCTCCAGCTGCGCACCTCCGGCCCTCACTGCACGCGCCAG<br>CCTTCTTTGTGCGGTCGGGTAAACAGAGGCGGAGTCCCCTCGCCTCGCCTCCCGC<br>TAACCATTGTTGCCTCCATCTCTTCCCGTAGGGCTTCTATTTCGACtccggatccggagagg<br>gcaggggatctctccttacttgtggcgacgtggaggagaacccggccccATGGTGAGCAAGGGCGA<br>GGAGCTGTTCACCGGGGTGGTGCCCATCCTGGTCGAGCTGGACGGCGACGTAAACG<br>GCCACAAGTTCAGCGTGTCCGGCGAGGGCGAGGGCGATGCCACCTACGGCAAGCT<br>GACCCTGAAGTTCATCTGCACCACCGGCAAGCTGCCCGTGCCCTGGCCCACCCTCGT | 1806 |

TABLE 5-continued

CONSTRUCTS USED FOR EVALUATION OF PREDICTED LOCI

| Construct name | Sequence | Length |
|---|---|---|
| | GACCACCCTGACCTACGGCGTGCAGTGCTTCAGCCGCTACCCCGACCACATGAAGCA<br>GCACGACTTCTTCAAGTCCGCCATGCCCGAAGGCTACGTCCAGGAGCGCACCATCTT<br>CTTCAAGGACGACGGCAACTACAAGACCCGCGCCGAGGTGAAGTTCGAGGGCGAC<br>ACCCTGGTGAACCGCATCGAGCTGAAGGGCATCGACTTCAAGGAGGACGGCAACAT<br>CCTGGGGCACAAGCTGGAGTACAACTACAACAGCCACAACGTCTATATCATGGCCG<br>ACAAGCAGAAGAACGGCATCAAGGTGAACTTCAAGATCCGCCACAACATCGAGGAC<br>GGCAGCGTGCAGCTCGCCGACCACTACCAGCAGAACACCCCCATCGGCGACGGCCC<br>CGTGCTGCTGCCCGACAACCACTACCTGAGCACCCAGTCCAAGCTGAGCAAAGACCC<br>CAACGAGAAGCGCGATCACATGGTCCTGCTGGAGTTCGTGACCGCCGCCGGGATCA<br>CTCTCGGCATGGACGAGCTGTACAAatgattgttttattgcagcttataatggttacaaataaagcaa<br>tagcatcacaaatttcacaaataaagcatttttttcactgcattctagttgtggtttgtccaaactcatcaatgtat<br>cttatCGCGATGATGTGGCTCTGGAAGGCGTGAGCCACTTCTTCCGCGAATTGGCCGA<br>GGAGAAGCGCGAGGGCTACGAGCGTCTCCTGAAGATGCAAAACCAGCGTGGCGGC<br>CGCGCTCTCTTCCAGGACATCAAGGTAACTAGTGTGTGGGTAATGGACTACATCTCC<br>CAGCAGGCCGTGCGCGCGAGGAGCCTTGATTTGAGGGCGTAGGTGTCGCGTGGGC<br>TTCTGGGAGATTGAGTTCGGTCTTGTGAGCCCTCTTAACCGCTGGAAATAGAGGCGC<br>ACCTCGTGCAGTGCCCACAACACGCGGCAGTCCACACCGCTGCGTGGTCTTAGGGA<br>CGTATAGCTGTAAGAGCTAGGACAGGGTGCGGAGAGTGATAAATACAAGCTGTCAC<br>ATGTCTTTGTGGCCTGGGCCTCTGACCCCCAACGACTCTTGGGAAATGTAGGTTTAG<br>TTCT (SEQ ID NO: 146) | |
| pARBI-927: FTL_2_Endo genous_29 | TGGGGCGGGGGGCTGAGACTCCTATGTGCTCCGGATTGGTCAGGCACGGCCTTCGG<br>CCCCGCCTCCTGCCACCGCAGATTGGCCGCTAGCCCTCCCCGAGCGCCCTGCCTCCG<br>AGGGCCGGCGCACCATAAAAGAAGCCGACCCTAGCCACGTCCCCTCGCAGTTCGGCG<br>GTCCCGCGGGTCTGTCTCTTGCTTCAACAGTGTTTGGACGGAACAGATCCGGGGACT<br>CTCTTCCAGCCTCCGACCGCCCTCCGATTTCCTCTCCGCTTGCAACCTCCGGGACCAT<br>CTTCTCGGCCATCTCCTGCTTCTGGGACCTGCCAGCACCGTTTTTGTGGTTAGCTCCT<br>TCTTGCCAACCAACCATGAGCTCCCAGATTCGTCAGAATTATTCCACCGACGTGGAG<br>GCAGCCGTCAACAGCCTGGTCAATTTGTACCTGCAGGCCTCCTACACCTACtccggatcc<br>ggagagggcagggatctctccttacttgtggcgacgtggaggagaacccggccccATGGTGAGCAAG<br>GGCGAGGAGCTGTTCACCGGGGTGGTGCCCATCCTGGTCGAGCTGGACGGCGACG<br>TAAACGGCCACAAGTTCAGCGTGTCCGGCGAGGGCGAGGGCGATGCCACCTACGG<br>CAAGCTGACCCTGAAGTTCATCTGCACCACCGGCAAGCTGCCCGTGCCCTGGCCCAC<br>CCTCGTGACCACCCTGACCTACGGCGTGCAGTGCTTCAGCCGCTACCCCGACCACAT<br>GAAGCAGCACGACTTCTTCAAGTCCGCCATGCCCGAAGGCTACGTCCAGGAGCGCA<br>CCATCTTCTTCAAGGACGACGGCAACTACAAGACCCGCGCCGAGGTGAAGTTCGAG<br>GGCGACACCCTGGTGAACCGCATCGAGCTGAAGGGCATCGACTTCAAGGAGGACG<br>GCAACATCCTGGGGCACAAGCTGGAGTACAACTACAACAGCCACAACGTCTATATCA<br>TGGCCGACAAGCAGAAGAACGGCATCAAGGTGAACTTCAAGATCCGCCACAACATC<br>GAGGACGGCAGCGTGCAGCTCGCCGACCACTACCAGCAGAACACCCCCATCGGCGA<br>CGGCCCCGTGCTGCTGCCCGACAACCACTACCTGAGCACCCAGTCCAAGCTGAGCAA<br>AGACCCCAACGAGAAGCGCGATCACATGGTCCTGCTGGAGTTCGTGACCGCCGCCG<br>GGATCACTCTCGGCATGGACGAGCTGTACAAatgattgttttattgcagcttataatggttacaaat<br>aaagcaatagcatcacaaatttcacaaataaagcatttttttcactgcattctagttgtggtttgtccaaactcat<br>caatgtatcttatCTCTCTCTGGTGAGTCCCCAGGACGCCCCTGGCCCTAATTTCCTCCAG<br>CTGCGCACCTCCGGCCCTCACTGCACGCGCCAGCCTTCTTTGTGCGGTCGGGTAAAC<br>AGAGGGCGGAGTCCCCTTGGCCTCGCCTCCCGCTAACCATTGTTGCCTCCATCTCTTC<br>CCGTAGGGCTTCTATTTCGACCGCGATGATGTGGCTCTGGAAGGCGTGAGCCACTTC<br>TTCCGCGAATTGGCCGAGGAGAAGCGCGAGGGCTACGAGCGTCTCCTGAAGATGC<br>AAAACCAGCGTGGCGGCCGCGCTCTCTTCCAGGACATCAAGGTAACTAGTGTGTGG<br>GTAATGGACTACATCTCCCAGCAGGCCGTGCGCGCGAGGAGCCTTGATTTGAGGGC<br>GTAGGTGTCGCGTGGGCTTCTGGGAGATTGAGTTCGGTCTTGTGAGCCCTCTTAACC<br>GCTGGA (SEQ ID NO: 147) | 1806 |
| pARBI-928: PTEN_1_En dogenous_ 31 | CTTTGCATAGTTTATCCTATTAGTAATCTATTCTGTCTTTGGAATATGTTTTGTGATGA<br>TGAAATAAATACTATAAATAGTATTATTCCTTTTGCATTGAGAGTCCTGACGAAATGT<br>CCATGTGACAGTTCATTTTGGGTTTAGCTCTACCTCTAATATGTGACCTATGCTACCA<br>GTCCGTATAGCGTAAATTCCCAGAATATATCCTCCTGAATAAAATGGGGAAAATAA<br>TACCTGGCTTCCTTAATGATTATATTTAAGACTTATCAAGAGACTATTTTCTATTTAAC<br>AATTAGAAAGTTAAGCAATACATTATTTTTCTCTGGAATCCAGTGTTTCTTTTAAATAC<br>CTGTTAAGTTTGTATGCAACATTTCTAAAGTTACCTACTTGTTAATTAAAAAATTCAAG<br>AGTTTTTTTTCTTATTCTGAGGTTATCTTTTTACCACAGTTTccggatccggagagggcagg<br>ggatctctccttacttgtggcgacgtggaggagaacccggccccATGGTGAGCAAGGGCGAGGAG<br>CTGTTCACCGGGGTGGTGCCCATCCTGGTCGAGCTGGACGGCGACGTAAACGGCCA<br>CAAGTTCAGCGTGTCCGGCGAGGGCGAGGGCGATGCCACCTACGGCAAGCTGACC<br>CTGAAGTTCATCTGCACCACCGGCAAGCTGCCCGTGCCCTGGCCCACCCTCGTGACC<br>ACCCTGACCTACGGCGTGCAGTGCTTCAGCCGCTACCCCGACCACATGAAGCAGCAC<br>GACTTCTTCAAGTCCGCCATGCCCGAAGGCTACGTCCAGGAGCGCACCATCTTCTTC<br>AAGGACGACGGCAACTACAAGACCCGCGCCGAGGTGAAGTTCGAGGGCGACACCC<br>TGGTGAACCGCATCGAGCTGAAGGGCATCGACTTCAAGGAGGACGGCAACATCCTG<br>GGGCACAAGCTGGAGTACAACTACAACAGCCACAACGTCTATATCATGGCCGACAA<br>GCAGAAGAACGGCATCAAGGTGAACTTCAAGATCCGCCACAACATCGAGGACGGCA<br>GCGTGCAGCTCGCCGACCACTACCAGCAGAACACCCCCATCGGCGACGGCCCCGTG<br>CTGCTGCCCGACAACCACTACCTGAGCACCCAGTCCAAGCTGAGCAAAGACCCCAAC<br>GAGAAGCGCGATCACATGGTCCTGCTGGAGTTCGTGACCGCCGCCGGGATCACTCT | 1806 |

TABLE 5-continued

CONSTRUCTS USED FOR EVALUATION OF PREDICTED LOCI

| Construct name | Sequence | Length |
|---|---|---|
| | CGGCATGGACGAGCTGTACAAatgattgtttattgcagcttataatggttacaaataaagcaatagca<br>tcacaaatttcacaaataaagcattttttcactgcattctagttgtggtttgtccaaactcatcaatgtatcttat<br>GCACAATATCCTTTTGAAGACCATAACCCACCACAGCTAGAACTTATCAAACCCTTTT<br>GTGAAGATCTTGACCAATGGCTAAGTGAAGATGACAATCATGTTGCAGCAATTCACT<br>GTAAAGCTGGAAAGGGACGAACTGGTGTAATGATATGTGCATATTTATTACATCGG<br>GGCAAATTTTTAAAGGCACAAGAGGCCCTAGATTTCTATGGGGAAGTAAGGACCAG<br>AGACAAAAGGTAAGTTATTTTTTGATGTTTTTCCTTTCCTCTTCCTGGATCTGAGAAT<br>TTATTGGAAAACAGATTTTGGGTTTCTTTTTTTCCTTCAGTTTTATTGAGGTGTAATTG<br>ACAAGTAAAAATTATATATAAATACAATGTATAATATGATGTTTTGATGTATGTGTAT<br>ATACATTGTGAAATGATTACTACAGTCAAACTACTTAACATATTCAT (SEQ ID NO: 148) | |
| pARBI-929: PTEN_2_En dogenous_ 32 | GCTACCAGTCCGTATAGCGTAAATTCCCAGAATATATCCTCCTGAATAAAATGGGGG<br>AAAATAATACCTGGCTTCCTTAATGATTATATTTAAGACTTATCAAGAGACTATTTTCT<br>ATTTAACAATTAGAAAGTTAAGCAATACATTATTTTTCTCTGGAATCCAGTGTTTCTTT<br>TAAATACCTGTTAAGTTTGTATGCAACATTTCTAAAGTTACCTACTTGTTAATTAAAA<br>ATTCAAGAGTTTTTTTTTTCTTATTCTGAGGTTATCTTTTTACCACAGTTGCACAATATC<br>CTTTTGAAGACCATAACCCACCACAGCTAGAACTTATCAAACCCTTTTGTGAAGATCT<br>TGACCAATGGCTAAGTGAAGATGACAATCATGTTGCAGCAATTCACTGTAAAGCTG<br>GAAAGGGACGAACTGGTGTAATGATATGTGCATATTTATTACATtccggatccggagagg<br>gcaggggatctctccttacttgtggcgacgtggaggagaaccccggccccATGGTGAGCAAGGGCGA<br>GGAGCTGTTCACCGGGGTGGTGCCCATCCTGGTCGAGCTGGACGGCGACGTAAACG<br>GCCACAAGTTCAGCGTGTCCGGCGAGGGCGAGGGCGATGCCACCTACGGCAAGCT<br>GACCCTGAAGTTCATCTGCACCACCGGCAAGCTGCCCGTGCCCTGGCCCACCCTCGT<br>GACCACCCTGACCTACGGCGTGCAGTGCTTCAGCCGCTACCCCGACCACATGAAGCA<br>GCACGACTTCTTCAAGTCCGCCATGCCCGAAGGCTACGTCCAGGAGCGCACCATCTT<br>CTTCAAGGACGACGGCAACTACAAGACCCGCGCCGAGGTGAAGTTCGAGGGCGAC<br>ACCCTGGTGAACCGCATCGAGCTGAAGGGCATCGACTTCAAGGAGGACGGCAACAT<br>CCTGGGGCACAAGCTGGAGTACAACTACAACAGCCACAACGTCTATATCATGGCCG<br>ACAAGCAGAAGAACGGCATCAAGGTGAACTTCAAGATCCGCCACAACATCGAGGAC<br>GGCAGCGTGCAGCTCGCCGACCACTACCAGCAGAACACCCCCATCGGCGACGGCCC<br>CGTGCTGCTGCCCGACAACCACTACCTGAGCACCCAGTCCAAGCTGAGCAAAGACCC<br>CAACGAGAAGCGCGATCACATGGTCCTGCTGGAGTTCGTGACCGCCGCCGGGATCA<br>CTCTCGGCATGGACGAGCTGTACAAatgattgtttattgcagcttataatggttacaaataaagcaa<br>tagcatcacaaatttcacaaataaagcattttttcactgcattctagttgtggtttgtccaaactcatcaatgtat<br>cttatCGGGGCAAATTTTTAAAGGCACAAGAGGCCCTAGATTTCTATGGGGAAGTAAG<br>GACCAGAGACAAAAGGTAAGTTATTTTTTGATGTTTTTCCTTTCCTCTTCCTGGATCT<br>GAGAATTTATTGGAAAACAGATTTTGGGTTTCTTTTTTTCCTTCAGTTTTATTGAGGT<br>GTAATTGACAAGTAAAAATTATATATAAATACAATGTATAATATGATGTTTTGATGTA<br>TGTGTATATACATTGTGAAATGATTACTACAGTCAAACTACTTAACATATTCATCACC<br>TCACATAATTATTATTCTCCCCCCAGGGTGAAAGCATTTAAGATCTACAAGCTACAAT<br>TTTCAATTATACAATGTTATTATTAACTATAGTCACTATGCTGTCCAGTAGAGCTTCA<br>GATCTTGTTCATCTTGTGTTCCTCCCTCCCCACCCTCAGTCCCTGGAA (SEQ ID NO: 149) | 1806 |
| pARBI-930: PTEN_3_En dogenous_ 33 | ATAAATAGTATTATTCCTTTTGCATTGAGAGTCCTGACGAAATGTCCATGTGACAGTT<br>CATTTTGGGTTTAGCTCTACCTCTAATATGTGACCTATGCTACCAGTCCGTATAGCGT<br>AAATTCCCAGAATATATCCTCCTGAATAAAATGGGGGAAAATAATACCTGGCTTCCT<br>TAATGATTATATTTAAGACTTATCAAGAGACTATTTTCTATTTAACAATTAGAAAGTT<br>AAGCAATACATTATTTTTCTCTGGAATCCAGTGTTTCTTTTAAATACCTGTTAAGTTTG<br>TATGCAACATTTCTAAAGTTACCTACTTGTTAATTAAAAATTCAAGAGTTTTTTTTTCT<br>TATTCTGAGGTTATCTTTTTACCACAGTTGCACAATATCCTTTTGAAGACCATAACCCA<br>CCACAGCTAGAACTTATCAAACCCTTTTGTGAAGATCTTGACtccggatccggagagggcag<br>gggatctctccttacttgtggcgacgtggaggagaaccccggccccATGGTGAGCAAGGGCGAGGA<br>GCTGTTCACCGGGGTGGTGCCCATCCTGGTCGAGCTGGACGGCGACGTAAACGGCC<br>ACAAGTTCAGCGTGTCCGGCGAGGGCGAGGGCGATGCCACCTACGGCAAGCTGAC<br>CCTGAAGTTCATCTGCACCACCGGCAAGCTGCCCGTGCCCTGGCCCACCCTCGTGAC<br>CACCCTGACCTACGGCGTGCAGTGCTTCAGCCGCTACCCCGACCACATGAAGCAGCA<br>CGACTTCTTCAAGTCCGCCATGCCCGAAGGCTACGTCCAGGAGCGCACCATCTTCTT<br>CAAGGACGACGGCAACTACAAGACCCGCGCCGAGGTGAAGTTCGAGGGCGACACC<br>CTGGTGAACCGCATCGAGCTGAAGGGCATCGACTTCAAGGAGGACGGCAACATCCT<br>GGGGCACAAGCTGGAGTACAACTACAACAGCCACAACGTCTATATCATGGCCGACA<br>AGCAGAAGAACGGCATCAAGGTGAACTTCAAGATCCGCCACAACATCGAGGACGGC<br>AGCGTGCAGCTCGCCGACCACTACCAGCAGAACACCCCCATCGGCGACGGCCCCGT<br>GCTGCTGCCCGACAACCACTACCTGAGCACCCAGTCCAAGCTGAGCAAAGACCCCAA<br>CGAGAAGCGCGATCACATGGTCCTGCTGGAGTTCGTGACCGCCGCCGGGATCACTC<br>TCGGCATGGACGAGCTGTACAAatgattgtttattgcagcttataatggttacaaataaagcaatagc<br>atcacaaatttcacaaataaagcattttttcactgcattctagttgtggtttgtccaaactcatcaatgtatctta<br>tCAATGGCTAAGTGAAGATGACAATCATGTTGCAGCAATTCACTGTAAAGCTGGAAA<br>GGGACGAACTGGTGTAATGATATGTGCATATTTATTACATCGGGGCAAATTTTTAAA<br>GGCACAAGAGGCCCTAGATTTCTATGGGGAAGTAAGGACCAGAGACAAAAGGTA<br>AGTTATTTTTGATGTTTTTCCTTTCCTCTTCCTGGATCTGAGAATTTATTGGAAACA<br>GATTTTGGGTTTCTTTTTTTCCTTCAGTTTTATTGAGGTGTAATTGACAAGTAAAAATT<br>ATATATAAATACAATGTATAATATGATGTTTTGATGTATGTGTATATACATTGTGAAA<br>TGATTACTACAGTCAAACTACTTAACATATTCATCACCTCACATAATTATTATTCTCCC | 1806 |

TABLE 5-continued

CONSTRUCTS USED FOR EVALUATION OF PREDICTED LOCI

| Construct name | Sequence | Length |
|---|---|---|
| | CCCAGGGTGAAAGCATTTAAGATCTACAAGCTACAATTTTCAATTAT (SEQ ID NO: 150) | |
| pARBI-931: PTPN2_1_Endogenous_34 | TAGTGACGGTATCAAGAGCAGCATCCCAGGTTGACTTTCTTTGGGGCAGGACCTTGC<br>TTGTGTCTTAACCCTTGGTTCCTACCcaagtttgtctctctagtcctcaactctgaaagccacttgatat<br>cttacacaattcctttttgcctgagaaaataaaagtcagttttgatcatttacaaccaaaaatcctaactaacac<br>aGACCTGTTTTTGAAATCAGGTAGATTGGAAGTCTTGGTTTACTTCTTATAAGCCCGT<br>CCGCTGTCTGTCTTGTAACATCCCAGGAGCAGACTTAACAAGGCCTTCCTGGAGCCT<br>TGCTCTTTCTGTCTGCTTCCCTCATCTGctctctctcctctctctTCACAGGGTCCACTTCCTA<br>ACACATGCTGCCATTTCTGGCTTATGGTTTGGCAGCAGAAGACCAAAGCAGTTGTCA<br>TGCTGAACCGCTccggatccggagagggcaggggatctctccttacttgtggcgacgtggaggagaaccc<br>cggccccATGGTGAGCAAGGGCGAGGAGCTGTTCACCGGGGTGGTGCCCATCCTGGT<br>CGAGCTGGACGGCGACGTAAACGGCCACAAGTTCAGCGTGTCCGGCGAGGGCGAG<br>GGCGATGCCACCTACGGCAAGCTGACCCTGAAGTTCATCTGCACCACCGGCAAGCT<br>GCCCGTGCCCTGGCCCACCCTCGTGACCACCCTGACCTACGGCGTGCAGTGCTTCAG<br>CCGCTACCCCGACCACATGAAGCAGCACGACTTCTTCAAGTCCGCCATGCCCGAAGG<br>CTACGTCCAGGAGCGCACCATCTTCTTCAAGGACGACGGCAACTACAAGACCCGCGC<br>CGAGGTGAAGTTCGAGGGCGACACCCTGGTGAACCGCATCGAGCTGAAGGGCATC<br>GACTTCAAGGAGGACGGCAACATCCTGGGGCACAAGCTGGAGTACAACTACAACAG<br>CCACAACGTCTATATCATGGCCGACAAGCAGAAGAACGGCATCAAGGTGAACTTCA<br>AGATCCGCCACAACATCGAGGACGGCAGCGTGCAGCTCGCCGACCACTACCAGCAG<br>AACACCCCCATCGGCGACGGCCCCGTGCTGCTGCCCGACAACCACTACCTGAGCACC<br>CAGTCCAAGCTGAGCAAAGACCCCAACGAGAAGCGCGATCACATGGTCCTGCTGGA<br>GTTCGTGACCGCCGCCGGGATCACTCTCGGCATGGACGAGCTGTACAAatgattgtttat<br>tgcagcttataatggttacaaataaagcaatagcatcacaaatttcacaaataaagcattttttcactgcattct<br>agttgtggttgtccaaactcatcaatgtatcttatATTGTGGAGAAAGAATCGGTGAGTAATATT<br>TAATATTTACAACTTAGTATACTGTATGTGATCATTAGCATATAAAGATTTTCATTTTG<br>GGGCCAATATTCATTCCTTAGTTTTGGCCTTTAATTGCTAAAGGCTAGCGGTCAAAGT<br>GTTTCTGTCCGGAAAAACTCATGTATCCTTTTCCTTTCTTAAGTATTTTTATAACAATT<br>GCAGACCTTTCATCTCCAAGATAGAAATACAATGGAATAAATATGGACTAGCAGTGA<br>CATATAGATCTTTGGAATCCTAGGAATCCTTATTGACCTATTGTCAATAAGTCCTCTT<br>CCAGCTTTAAGATCTTGTACTGTTCTACTTCAGATTTCTTACTTTATTCTACATTTCATA<br>ATTGCTGGTTTTTAATGATGATGAAAATTTCCTAATCCACTTCTAATTAGATGTGGCA<br>ATGACATGCC (SEQ ID NO: 151) | 1806 |
| pARBI-932: PTPN2_2_Endogenous_35 | CAGAATTTGAATATGATGTGGCTGACCATAGATACCTCCATTGCATTAATTCTGCTTC<br>ATAAAGTGTTTGATGCTTGCTTGTAGGTGTTGAATAGAGCCTAATTAGCAGTAAGTA<br>AACAGATCTagagcacagactttggcatctgaaggaccttggttcaatgctgggactgccacttactagcta<br>tgggatctttggtggattttaacctttgaaagcctttcatccctcacagatataatggggaagaaaatcgtttcc<br>attagtattgtgaggattaaatgattaattgatgtaaacaatgtgctttccatagtacttggcatatcataagtgc<br>ttcatgTTTATTTTACGCTGGCTGGGAAGATAAGTTTTGCTGTGGAGAATTTAAGAGAG<br>ATATTAAAATATATTTTTGTTATTTTAAGGAAATTCGAAATGAGTCCCATGACTccggat<br>ccggagagggcaggggatctctccttacttgtggcgacgtggaggagaacccggccccATGGTGAGCA<br>AGGGCGAGGAGCTGTTCACCGGGGTGGTGCCCATCCTGGTCGAGCTGGACGGCGA<br>CGTAAACGGCCACAAGTTCAGCGTGTCCGGCGAGGGCGAGGGCGATGCCACCTAC<br>GGCAAGCTGACCCTGAAGTTCATCTGCACCACCGGCAAGCTGCCCGTGCCCTGGCCC<br>ACCCTCGTGACCACCCTGACCTACGGCGTGCAGTGCTTCAGCCGCTACCCCGACCAC<br>ATGAAGCAGCACGACTTCTTCAAGTCCGCCATGCCCGAAGGCTACGTCCAGGAGCG<br>CACCATCTTCTTCAAGGACGACGGCAACTACAAGACCCGCGCCGAGGTGAAGTTCG<br>AGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATA<br>TCATGGCCGACAAGCAGAAGAACGGCATCAAGGTGAACTTCAAGATCCGCCACAAC<br>ATCGAGGACGGCAGCGTGCAGCTCGCCGACCACTACCAGCAGAACACCCCCATCGG<br>CGACGGCCCCGTGCTGCTGCCCGACAACCACTACCTGAGCACCCAGTCCAAGCTGA<br>GCAAAGACCCCAACGAGAAGCGCGATCACATGGTCCTGCTGGAGTTCGTGACCGCC<br>GCCGGGATCACTCTCGGCATGGACGAGCTGTACAAatgattgtttattgcagcttataatggtt<br>acaaataaagcaatagcatcacaaatttcacaaataaagcattttttcactgcattctagttgtggtttgtccaa<br>actcatcaatgtatcttatTATCCTCATAGAGTGGCCAAGTTTCCAGAAAACAGAAATCGAA<br>ACAGATACAGAGATGTAAGCCCATGTAAGTACTTGTGGGTTTGTGTGCATGTGTATT<br>TTTTGGTTTGTTTTAGGAGGCAGGATGTAGTGAAAAGGAGGGCTTGGGGTCAGTGT<br>TGATAAATACAGTAATTTTTTCCTATTTACGTAAGACACGTTCTTTAAGAATTTAAA<br>GGTGTAGAATAGTGGAAGGAAAAATAATTACCCATAATTATTTCATCCTTCAAACAT<br>AGGCACCATTATTTTGGTGTATTTCCCACAACCTGTTTTCTTATGCACAGTTTTCCTT<br>TCTTTAAAATAATTGTAATTATAGATGTCTATATAATATCCATATGTATTTCCTTTTCAT<br>ATCATTCCATCCCCTTTGTAAGTTTTGCTTAAAATAGTTATTGGTGTAGTTTGGTTTTT<br>T (SEQ ID NO: 152) | 1806 |
| pARBI-933: PTPN2_3_Endogenous_36 | ACCAGTTATCGTTTGTAGGTAGACCAATCAATTCTTAGGTACCAAGAATCTGAATG<br>ATCCTTTTACTTTTAGGAAGGTAAGTACTTTATTCATTTAACTATGTTTACTCCTGGTC<br>GATTTTTCAAGTCACAATGGCTAATGTGCTACAAACAGAAGTTGCTACTAATAGTTT<br>TATAGTAATAAAACAAGATTGCATTTTATACTCCTTACAAAAAAGTAGAGAATAGTTT<br>AGGATTTGTCTCAACTCTATTATGATGCTAATTCATTTTTCTTATTTCTTCTGTCTTTTT<br>ATAAATACCTAGAATATTAATATGAAGATAAAAACAGTAATTTTGAAATGACAGTTG<br>TGGTTTATCATTCTCTATTTTCAGATGATCACAGTCGTGTTAAACTGCAAAATGCTGA<br>GAATGATTATATTAATGCCAGTTTAGTTGACATAGAAGAGGCAtccggatccggagaggg | 1806 |

TABLE 5-continued

CONSTRUCTS USED FOR EVALUATION OF PREDICTED LOCI

| Construct name | Sequence | Length |
|---|---|---|
| | cagggatctctccttacttgtggcgacgtggaggagaaccccggccccATGGTGAGCAAGGGCGAG<br>GAGCTGTTCACCGGGGTGGTGCCCATCCTGGTCGAGCTGGACGGCGACGTAAACGG<br>CCACAAGTTCAGCGTGTCCGGCGAGGGCGAGGGCGATGCCACCTACGGCAAGCTG<br>ACCCTGAAGTTCATCTGCACCACCGGCAAGCTGCCCGTGCCCTGGCCCACCCTCGTG<br>ACCACCCTGACCTACGGCGTGCAGTGCTTCAGCCGCTACCCCGACCACATGAAGCAG<br>CACGACTTCTTCAAGTCCGCCATGCCCGAAGGCTACGTCCAGGAGCGCACCATCTTC<br>TTCAAGGACGACGGCAACTACAAGACCCGCGCCGAGGTGAAGTTCGAGGGCGACA<br>CCCTGGTGAACCGCATCGAGCTGAAGGGCATCGACTTCAAGGAGGACGGCAACATC<br>CTGGGGCACAAGCTGGAGTACAACTACAACAGCCACAACGTCTATATCATGGCCGA<br>CAAGCAGAAGAACGGCATCAAGGTGAACTTCAAGATCCGCCACAACATCGAGGACG<br>GCAGCGTGCAGCTCGCCGACCACTACCAGCAGAACACCCCCATCGGCGACGGCCCC<br>GTGCTGCTGCCCGACAACCACTACCTGAGCACCCAGTCCAAGCTGAGCAAAGACCCC<br>AACGAGAAGCGCGATCACATGGTCCTGCTGGAGTTCGTGACCGCCGCCGGGATCAC<br>TCTCGGCATGGACGAGCTGTACAAatgattgtttattgcagcttataatggttacaaataaagcaat<br>agcatcacaaatttcacaaataaagcatttttttcactgcattctagttgtggtttgtccaaactcatcaatgtatc<br>ttatCAAAGGAGTTACATCTTAACACAGGCAAGTAATACGATACCACGCAAATGTCTG<br>AAAATGATGTGTTTGTGCTTGTTCTGCTTTAAATCATAGGTAAAAGTATATCTTGACT<br>TCTTTTGGAAATGAAATGGTATTTCAGTTTTTTTCTGACGATGTAATGAATTATGGAC<br>ATTATAAGGTTTTGAAGCTTTGAGTATTTAAGATAAAAGGCAAGTTATTTTTGATATT<br>ACACGTTCTGTGAAGGAAAATTCTTAGGAAATGGCTTAGGCCAGTTCTTTGGCAGAT<br>TGTGTTCCTTACATTATATCTGACACAGAGTGCTGCTTATGCTTCTTAGTGTCTTCTTT<br>TCTCTTCCCATACCCTGTGGCAAAACCAGAGGCCCTGGACAGCTCTTCTGTAGCTCCC<br>CCTGCCTCGCATATATCTTCAGAGAGTACACCAAGCCCTGGATGGTGT (SEQ ID NO: 153) | |
| pARBI-934: PTPN6_1_E ndogenous _37 | CCTGCTCAAGGGCCGAGGTGTCCACGGTAGCTTCCTGGCTCGGCCCAGTCGCAAGA<br>ACCAGGGTGACTTCTCGCTCTCCGTCAGGTAGGTGGGCCCCCCGCAACCCCGGGCAT<br>TTTGGCCACTCTCTTGTGCCATCCAGGCCCTGAACCACTCATTCCTGGTTCCCGTGG<br>CAGTGCTGACTCCCCGTCTGTTCCCTTGCCCCAACCCCCACACTCCCCATCCCTGTCT<br>GTGCCCACCCATGCCCATGTGTGCCCCCACCCAGGACCTCAGCCGATCCCTGCCCTCC<br>TGCCTCTACTCCTGCACCGACTGGCCTCACCGCCTGGTGCCCTGCAGGGTGGGGGAT<br>CAGGTGACCCATATTCGGATCCAGAAGAACTCAGGGGATTTCTATGACCTGTATGGAGG<br>GGAGAAGTTTCGACTCTGACAGAGCTGGTGGAGTACTACACTCAGCAGtccggatcc<br>ggagagggcaggggatctctccttacttgtggcgacgtggaggagaaccccggccccATGGTGAGCAAG<br>GGCGAGGAGCTGTTCACCGGGGTGGTGCCCATCCTGGTCGAGCTGGACGGCGACG<br>TAAACGGCCACAAGTTCAGCGTGTCCGGCGAGGGCGAGGGCGATGCCACCTACGG<br>CAAGCTGACCCTGAAGTTCATCTGCACCACCGGCAAGCTGCCCGTGCCCTGGCCCAC<br>CCTCGTGACCACCCTGACCTACGGCGTGCAGTGCTTCAGCCGCTACCCCGACCACAT<br>GAAGCAGCACGACTTCTTCAAGTCCGCCATGCCCGAAGGCTACGTCCAGGAGCGCA<br>CCATCTTCTTCAAGGACGACGGCAACTACAAGACCCGCGCCGAGGTGAAGTTCGAG<br>GGCGACACCCTGGTGAACCGCATCGAGCTGAAGGGCATCGACTTCAAGGAGGACG<br>GCAACATCCTGGGGCACAAGCTGGAGTACAACTACAACAGCCACAACGTCTATATCA<br>TGGCCGACAAGCAGAAGAACGGCATCAAGGTGAACTTCAAGATCCGCCACAACATC<br>GAGGACGGCAGCGTGCAGCTCGCCGACCACTACCAGCAGAACACCCCCATCGGCGA<br>CGGCCCCGTGCTGCTGCCCGACAACCACTACCTGAGCACCCAGTCCAAGCTGAGCAA<br>AGACCCCAACGAGAAGCGCGATCACATGGTCCTGCTGGAGTTCGTGACCGCCGCCG<br>GGATCACTCTCGGCATGGACGAGCTGTACAAatgattgtttattgcagcttataatggttacaaat<br>aaagcaatagcatcacaaatttcacaaataaagcatttttttcactgcattctagttgtggtttgtccaaactcat<br>caatgtatcttatCAGGGTGTCCTGCAGGACCGCGACGGCACCATCATCCACCTCAAGTA<br>CCCGCTGAACTGCTCCGATCCCACTAGTGAGAGGTGAGGGCTCCGCACCCCCGCCAT<br>TCCAAGCAGGGATGAGCCGGCTCCCACCCTGAACAGCCAGGGAGGCAGGGAGAC<br>TGGCAGCCGGCGCTGCCTACCCTCCATCCCCTCCCCTCCCTGCACCAGCTGGGGCTCT<br>CAATGTCCCTCCTCCCTGCTGTCCTGGGACCTGGTGTCTCAGAGCCTAACCTACCACC<br>CTTTCCACCTAACCCCGAGGAAGCCACAGAAAGCTGCCTCGCCCTACTCCGGGAGCC<br>CTGGCCGCTGCAACCCAGGTCCCACTGGAGACAGGGAGGCCACTGCTGGTGGCCAG<br>CATGTCGTGCAGGCCAGCTCTGTTGTTAGAAAGCTCTTCTTCCTCTGGAATCGAGCCT<br>GCCT (SEQ ID NO: 154) | 1806 |
| pARBI-935: PTPN6_2_E ndogenous _38 | CTGGGTTCGAAGCCCGGTTAGAACTCTGGAGGCTAGGATGGCTTGAACCTGGGAGG<br>TCGAGGCTGCAGAGAGCTGTAACCGCGCCACTGCACTCCAGCCTGGGCAACAGAGC<br>TCTGGAAGCTTGCCCTAGAGTCAGTCAAGGGCCCTAGGCCAGTGAGTAACAGCTCA<br>GCGTCAGTTTCCTCATCTATAAAATGGGGGTAATATCATACCTAGCTCTCAGCATGTT<br>TGTGAGAGACCTAAATGAGGTGGTGGATTTGGAAGCATGTAGCGCAGTGCCTGGCA<br>CACAGTAGGTGCTTGATTTCCGGCCCCTCTCTGTGAATGTCTCTGCTCAGCGCCTTCC<br>CCTGTGGCCTGGGTCTTACCTTCCCTGACGCTGCCTTCTCTAGGTGGTACCATGGCCA<br>CATGTCTGGCGGGCAGGCAGAGACCTGCAGGCCAAGGGCGAGCCCTGGTccg<br>gatccggagagggcaggggatctctccttacttgtggcgacgtggaggagaaccccggccccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA | 1806 |

TABLE 5-continued

CONSTRUCTS USED FOR EVALUATION OF PREDICTED LOCI

| Construct name | Sequence | Length |
|---|---|---|
| | TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttcactgcattctagttgtggtttgtcc<br>aaactcatcaatgtatcttatACGTTTCTTGTGCGTGAGAGCCTCAGCCAGCCTGGAGACTT<br>CGTGCTTTCTGTGCTCAGTGACCAGCCCAAGGCTGGCCCAGGCTCCCCGCTCAGGGT<br>CACCCACATCAAGGTCATGTGCGAGGTAAGGCAGCCAGGCGGCGGGGGAGCCTCT<br>GCTGAGGCTCCTGTCTGTGACCACAGTGTGGGTGGCAGGGAGGGTCTGCCTGGGCT<br>TGAATTCAAGGCTGGGGACCCAGGGAGGGAGACTCAAGTCCTGTGAATGGCCTAAT<br>TTGGCTCCCCCCAGGGTGGACGCTACACAGTGGGTGGTTTGGAGACCTTCGACAGC<br>CTCACGGACCTGGTGGAGCATTTCAAGAAGACGGGGATTGAGGAGGCCTCAGGCG<br>CCTTTGTCTACCTGCGGCAGGTCAGGGGTGGGCCCAGCTGCCTCCCCACTTCCCCTG<br>AGCTGTCCCCAGATGT (SEQ ID NO: 155) | 1806 |
| pARBI-936:<br>PTPN6_3_E<br>ndogenous<br>_39 | TGTCACATATGTGCAATGCCATGCTCCTGAGCCTTTGATTGCAGACGTGTGGGAAGT<br>GGGCCCCGTCCCCACCCCCAGTGCCACCCTGCTCTGCTTCTCTTCCCTTGCTGTGCTCT<br>AAAAACGAGAAGTACAAGTGAGTTCCCCCAAGGGGTCGGCCGCGCCTCTTCCTGTCC<br>CCGCCCTGCCGGCTGCCCCAGGCCAGTGGAGTGGCAGCCCCAGAACTGGGACCACC<br>GGGGGTGGTGAGGCGGCCCGGCACTGGGAGCTGCATCTGAGGCTTAGTCCCTGAG<br>CTCTCTGCCTGCCCAGACTAGCTGCACCTCCTCATTCCCTGCGCCCCTTCCTCTCCGG<br>AAGCCCCCAGGATGGTGAGGTAAGGGCCTGCCACCCACGGTAGACAGGAGGCAAG<br>GGTGCCTGGTGCCCACGGGACCCCTCCTCACTGCCCTGCCTGGGCCGCCCAGGtccgg<br>atccggagagggcagggatctctccttacttgtggcgacgtggaggagaaccccggccccATGGTGAGC<br>AAGGGCGAGGAGCTGTTCACCGGGGTGGTGCCCATCCTGGTCGAGCTGGACGGCG<br>ACGTAAACGGCCACAAGTTCAGCGTGTCCGGCGAGGGCGAGGGCGATGCCACCTA<br>CGGCAAGCTGACCCTGAAGTTCATCTGCACCACCGGCAAGCTGCCCGTGCCCTGGCC<br>CACCCTCGTGACCACCCTGACCTACGGCGTGCAGTGCTTCAGCCGCTACCCCGACCA<br>CATGAAGCAGCACGACTTCTTCAAGTCCGCCATGCCCGAAGGCTACGTCCAGGAGC<br>GCACCATCTTCTTCAAGGACGACGGCAACTACAAGACCCGCGCCGAGGTGAAGTTC<br>GAGGGCGACACCCTGGTGAACCGCATCGAGCTGAAGGGCATCGACTTCAAGGAGG<br>ACGGCAACATCCTGGGGCACAAGCTGGAGTACAACTACAACAGCCACAACGTCTAT<br>ATCATGGCCGACAAGCAGAAGAACGGCATCAAGGTGAACTTCAAGATCCGCCACAA<br>CATCGAGGACGGCAGCGTGCAGCTCGCCGACCACTACCAGCAGAACACCCCCATCG<br>GCGACGGCCCCGTGCTGCTGCCCGACAACCACTACCTGAGCACCCAGTCCAAGCTG<br>AGCAAAGACCCCAACGAGAAGCGCGATCACATGGTCCTGCTGGAGTTCGTGACCGC<br>CGCCGGGATCACTCTCGGCATGGACGAGCTGTACAAatgattgtttattgcagcttataatggt<br>tacaaataaagcaatagcatcacaaatttcacaaataaagcattttttcactgcattctagttgtggtttgtcca<br>aactcatcaatgtatcttatTGGTTTCACCGAGACCTCAGTGGGCTGGATGCAGAGACCCTG<br>CTCAAGGGCCGAGGTGTCCACGGTAGCTTCCTGGCTCGGCCCAGTCGCAAGAACCA<br>GGGTGACTTCTCGCTCTCCGTCAGGTAGGTGGGCCCCCGCAACCCCGGGCATTTTG<br>GCCACTCTCTTGTGCCATCCAGGCCCTGAACCACTCATTCCTGGTTCCCCGTGGCAGT<br>GCTGACTCCCGTCTGTTCCCTTGCCCCCAACCCCCACACTCCCCATCCCTGTCTGTGC<br>CCACCCATGCCCATGTGTGCCCCCACCCAGGACCTCAGCCGATCCCTGCCCTCCTGCC<br>TCTACTCCTGCACCGACTGGCCTCACCGCCTGGTGCCCTGCAGGGTGGGGGATCAG<br>GTGACCCATATTCGGATCCAGAACTCAGGGGATTTCTATGACCTGTATGGAGGGGA<br>GAAGTTTG (SEQ ID NO: 156) | 1806 |
| pARBI-937:<br>PTPRC_LE<br>ndogenous<br>_40 | TCTTTAGCTAATGTTCTGTAGCTTGTTTTAGATCTGTGTCTACATATTATATGTATCTC<br>TGTATGCATCAATATTTGTATATATGCATGCATATATGTGTATGTATATTTATGAATA<br>CATATACACACCATATACATACACTTATGTATGGTGTGTGCATATGTATGTGTAGATA<br>TATGTACATACACACTATAGTGGACTGGGGAGTTAGTATACTGGGAGGAGCATACA<br>TTTAGGGTATGATTCACATATTTATTTTGTCCTTCTCCCATTTTCCATTAATTAACAGG<br>ATTGACTACAGCAAAGATGCCCAGTGTTCCACTTTCAAGTGACCCCTTACCTACTCAC<br>ACCACTGCATTCTCACCCGCAAGCACCTTTGAAAGAGAAAATGACTTCTCAGAGACC<br>ACAACTTCTCTTAGTCCAGACAATACTTCCACCCAAGTATCCCCGtccggatccggagagg<br>gcaggggatctctccttacttgtggcgacgtggaggagaaccccggccccATGGTGAGCAAGGGCGA<br>GGAGCTGTTCACCGGGGTGGTGCCCATCCTGGTCGAGCTGGACGGCGACGTAAACG<br>GCCACAAGTTCAGCGTGTCCGGCGAGGGCGAGGGCGATGCCACCTACGGCAAGCT<br>GACCCTGAAGTTCATCTGCACCACCGGCAAGCTGCCCGTGCCCTGGCCCACCCTCGT<br>GACCACCCTGACCTACGGCGTGCAGTGCTTCAGCCGCTACCCCGACCACATGAAGCA<br>GCACGACTTCTTCAAGTCCGCCATGCCCGAAGGCTACGTCCAGGAGCGCACCATCTT<br>CTTCAAGGACGACGGCAACTACAAGACCCGCGCCGAGGTGAAGTTCGAGGGCGAC<br>ACCCTGGTGAACCGCATCGAGCTGAAGGGCATCGACTTCAAGGAGGACGGCAACAT<br>CCTGGGGCACAAGCTGGAGTACAACTACAACAGCCACAACGTCTATATCATGGCCG<br>ACAAGCAGAAGAACGGCATCAAGGTGAACTTCAAGATCCGCCACAACATCGAGGAC<br>GGCAGCGTGCAGCTCGCCGACCACTACCAGCAGAACACCCCCATCGGCGACGGCCC<br>CGTGCTGCTGCCCGACAACCACTACCTGAGCACCCAGTCCAAGCTGAGCAAAGACCC<br>CAACGAGAAGCGCGATCACATGGTCCTGCTGGAGTTCGTGACCGCCGCCGGGATCA<br>CTCTCGGCATGGACGAGCTGTACAAatgattgtttattgcagcttataatggttacaaataaagcaa<br>tagcatcacaaatttcacaaataaagcattttttcactgcattctagttgtggtttgtccaaactcatcaatgtat<br>cttatGACTCTTTGGATAATGCTAGTGCTTTTAATACCACAGGTTGGCACACAAAGTT<br>GTTAACTTAAATATCAGGGAATGTCATTTAGAAAATTCTACAGTTATCAGTACAACTT<br>GTCTTTAAATTATTTGCACAGTTTCTAAGTATGTGATTTTATTCAAGTGCAGAAATTG | 1806 |

TABLE 5-continued

CONSTRUCTS USED FOR EVALUATION OF PREDICTED LOCI

| Construct name | Sequence | Length |
|---|---|---|
| | CAGGAAATTAGTATCTGTGAAATATAGATCGACTGAAGTAATTAATGCATGTTGTTA<br>GGGAGTGGAGAGAGAAAAGAAGGGAAGCAAGATCTCCAAGGACAATCAGGAGGG<br>GAAATTTGTTCTAGTATCCTCTGATCTATACACACTCGCCATGATTCTCCCGCTTGGCT<br>TCCCGCCACCTGGACAGATGAGAATTTCCCTAGTTCAGAGATTATCAGTTCTACTCTC<br>CTTGGAAGGTGTCTTAAATGGGAGTCTTCCCATTTCTTTGTTTCACTCTAGA (SEQ ID<br>NO: 157) | |
| pARBI-938:<br>PTPRC_2_E<br>ndogenous<br>_41 | AGGGAATTTTTATATGTTGGTCATATTATATCCCTAGCATGTGGCATAATGTCTAGCA<br>CAAAATAGGTGCTCAATTAATCATCATTATCTAAATAAATAATGCATTTGGGAAAAA<br>AAAGTTTCAAAAGTTTTTCAAAAGTCTTTTGCAGGCTTGAAATTAATCCCAATAGTGA<br>TCCTTTAGTCTGTTATGTTTCTGATTTAGCCTGGGGATTCAAAAAATAAATAACATAA<br>TTTTGATATATTTGGGCTTTGTAAACATGGTACTAAGAGAGGAAATATAGTTTCATTA<br>GGGTAAAAGCTACTGAAAATTGCCACTTGGTGAATGTTCTATCATAGACTTGAGGTA<br>CATATAAAAATCTAATATATGTTTACATTAATATGAATGAAATTTGAAATTTTCTAAG<br>AGATTTTTGTTTCTTCTTTGCAGGGCAAAGCCCAACACCTTCCCCCtccggatccggagag<br>ggcaggggatctctccttacttgtggcgacgtggaggagaaccccggccccATGGTGAGCAAGGGCG<br>AGGAGCTGTTCACCGGGGTGGTGCCCATCCTGGTCGAGCTGGACGGCGACGTAAAC<br>GGCCACAAGTTCAGCGTGTCCGGCGAGGGCGAGGGCGATGCCACCTACGGCAAGC<br>TGACCCTGAAGTTCATCTGCACCACCGGCAAGCTGCCCGTGCCCTGGCCCACCCTCG<br>TGACCACCCTGACCTACGGCGTGCAGTGCTTCAGCCGCTACCCCGACCACATGAAGC<br>AGCACGACTTCTTCAAGTCCGCCATGCCCGAAGGCTACGTCCAGGAGCGCACCATCT<br>TCTTCAAGGACGACGGCAACTACAAGACCCGCGCCGAGGTGAAGTTCGAGGGCGA<br>CACCCTGGTGAACCGCATCGAGCTGAAGGGCATCGACTTCAAGGAGGACGGCAACA<br>TCCTGGGGCACAAGCTGGAGTACAACTACAACAGCCACAACGTCTATATCATGGCCG<br>ACAAGCAGAAGAACGGCATCAAGGTGAACTTCAAGATCCGCCACAACATCGAGGAC<br>GGCAGCGTGCAGCTCGCCGACCACTACCAGCAGAACACCCCCATCGGCGACGGCCC<br>CGTGCTGCTGCCCGACAACCACTACCTGAGCACCCAGTCCAAGCTGAGCAAAGACCC<br>CAACGAGAAGCGCGATCACATGGTCCTGCTGGAGTTCGTGACCGCCGCCGGGATCA<br>CTCTCGGCATGGACGAGCTGTACAAatgattgtttattgcagcttataatggttacaaataaagcaa<br>tagcatcacaaatttcacaaataaagcattttttcactgcattctagttgtggtttgtccaaactcatcaatgtat<br>cttatACTGGTAAGAATTAATATTTATATTTTTACTAATTTTATTTTCTTGTTGCAAAGTT<br>TATATATTTAACTACAATTTTCTATTATTAACACTGAAATATTTTTAAGGATAAATTT<br>TATAATCATGAGTGATTCTTGACATTCACTTGTTCTTAAACTTTCTGCTTATACGTTAT<br>AGAGTTTAATAACTACCTAAACATGTTATTAAATTTGTATATATATTTTGTGTATAAAT<br>AGTAACTTTTCCCAAACTTGACAGTAAATCACACAACAGGTTTCTACTCTCTTTTAATA<br>TTTTAAGACTATAAAAAAATGCATTTAAATTAGATAACAAAATTTTATAGTCTGAAAG<br>CAGGTTAACAGCTGTCTATGTATGTTATAGATATGTAGATAACAGATTTGCATATGTC<br>TATATTTCTTTAAGAGTATGTTGCTTTTTTCAATGGTATGCA (SEQ ID NO: 158) | 1806 |
| pARBI-939:<br>PTPRC_3_E<br>ndogenous<br>_42 | CCTTTAGCACCATAAAGAAACTAAATTATTTAGATGTTMATGAGAACATATCAAAA<br>AGTACTTTTCTGTCATCCAATACTTCCACAAATAAATCATTAGTTCTTTGCTAATCTTCA<br>TCTGGCATAAAAATAATGACATCAACTTTCTTCATGTAATTTCCCACTTAATTCCTTTA<br>CTAGGAGCAATATCAATTCCTATATGACGTCATTGCCAGCACCTACCCTGCTCAGAAT<br>GGACAAGTAAAGAAAAACAACCATCAAGAAGATAAAATTGAATTTGATAATGAAGT<br>GGACAAAGTAAAGCAGGATGCTAATTGTGTTAATCCACTTGGTGCCCCAGAAAAGC<br>TCCCTGAAGCAAAGGAACAGGCTGAAGGTTCTGAACCCACGAGTGGCACTGAGGG<br>GCCAGAACATTCTGTCAATGGTCCTGCAAGTCCAGCTTTAAATCAAGGTtccggatccgg<br>agagggcaggggatctctccttacttgtggcgacgtggaggagaaccccggccccATGGTGAGCAAGG<br>GCGAGGAGCTGTTCACCGGGGTGGTGCCCATCCTGGTCGAGCTGGACGGCGACGT<br>AAACGGCCACAAGTTCAGCGTGTCCGGCGAGGGCGAGGGCGATGCCACCTACGGC<br>AAGCTGACCCTGAAGTTCATCTGCACCACCGGCAAGCTGCCCGTGCCCTGGCCCACC<br>CTCGTGACCACCCTGACCTACGGCGTGCAGTGCTTCAGCCGCTACCCCGACCACATG<br>AAGCAGCACGACTTCTTCAAGTCCGCCATGCCCGAAGGCTACGTCCAGGAGCGCAC<br>CATCTTCTTCAAGGACGACGGCAACTACAAGACCCGCGCCGAGGTGAAGTTCGAGG<br>GCGACACCCTGGTGAACCGCATCGAGCTGAAGGGCATCGACTTCAAGGAGGACGG<br>CAACATCCTGGGGCACAAGCTGGAGTACAACTACAACAGCCACAACGTCTATATCAT<br>GGCCGACAAGCAGAAGAACGGCATCAAGGTGAACTTCAAGATCCGCCACAACATCG<br>AGGACGGCAGCGTGCAGCTCGCCGACCACTACCAGCAGAACACCCCCATCGGCGAC<br>GGCCCCGTGCTGCTGCCCGACAACCACTACCTGAGCACCCAGTCCAAGCTGAGCAA<br>AGACCCCAACGAGAAGCGCGATCACATGGTCCTGCTGGAGTTCGTGACCGCCGCCG<br>GGATCACTCTCGGCATGGACGAGCTGTACAAatgattgtttattgcagcttataatggttacaaat<br>aaagcaatagcatcacaaatttcacaaataaagcattttttcactgcattctagttgtggtttgtccaaactcat<br>caatgtatcttatTCATAGGAAAAGACATAAATGAGGAAACTCCAAACCTTCCTGTTAGCT<br>GTTATTTCTATTTTTGTAGAAGTAGGAAGTGAAAATAGGTATACAGTGGATTAATTA<br>AATGCAGCGAACCAATATTTGTAGAAGGGTTATATTTTACTACTGTGGAAAAATATT<br>TAAGATAGTTTTGCCAGAACAGTTTGTACAGACGTATGCTTATTTTAAAATTTTATCT<br>CTTATTCAGTAAAAAACAACTTCTTTGTAATCGTTATGTGTGTATATGTATGTGTGTA<br>TGGGTGTGTGTTTGTGTGAGAGACAGAGAAAGAGAGAGAATTCTTTCAAGTGAATC<br>TAAAAGCTTTTGCTTTTCCTTTGTTTTTATGAAGAAAAATACATTTTATATTAGAAGT<br>GTTAACTTAGCTTGAAGGGATCTGTTTTTAAAAATCATAAACTGTGTGCAGACTCAATA<br>(SEQ ID NO: 159) | 1806 |
| pARBI-940:<br>PTPRCAP_1<br>_Endogeno | aaggaaaaaggcactgagtgctgggggtgctgggtgggctgcagtgatagacatcagggtagaggttaag<br>gtcaggttcagcctcactggggtgaagtttgagcacggtgagcaggccatgcagcccggggaggggaggat<br>gggaggaggtggagctttccgggcagagggaacagccagtgcgaaggcccaggcaggtggcttaatgcag | 1806 |

TABLE 5-continued

CONSTRUCTS USED FOR EVALUATION OF PREDICTED LOCI

| Construct name | Sequence | Length |
|---|---|---|
| us_43 | ctgttggggggaggtgagtggtagggaggaggctggagggatgggggctgatctcacagggccagagcctggt<br>tgaccaaataaggccttggccttttctGCTTGGCTGTCCCAAGAGGATCCCAAAGAGAAAAA<br>ACGAAAGTGGTCTTGGTCACCCAGCCTGCCCCACACCAGGCCCCACCCCAGGTGCTG<br>AGCCCTCTGAGCCCTGCCTGTCTCCCACAGGCTCTGCCCTGCtccggatccggagagggc<br>aggggatctctccttacttgtggcgacgtggaggagaaccccggccccATGGTGAGCAAGGGCGAGG<br>AGCTGTTCACCGGGGTGGTGCCCATCCTGGTCGAGCTGGACGGCGACGTAAACGGC<br>CACAAGTTCAGCGTGTCCGGCGAGGGCGAGGGCGATGCCACCTACGGCAAGCTGA<br>CCCTGAAGTTCATCTGCACCACCGGCAAGCTGCCCGTGCCCTGGCCCACCCTCGTGA<br>CCACCCTGACCTACGGCGTGCAGTGCTTCAGCCGCTACCCCGACCACATGAAGCAGC<br>ACGACTTCTTCAAGTCCGCCATGCCCGAAGGCTACGTCCAGGAGCGCACCATCTTCT<br>TCAAGGACGACGGCAACTACAAGACCCGCGCCGAGGTGAAGTTCGAGGGCGACAC<br>CCTGGTGAACCGCATCGAGCTGAAGGGCATCGACTTCAAGGAGGACGGCAACATCC<br>TGGGGCACAAGCTGGAGTACAACTACAACAGCCACAACGTCTATATCATGGCCGAC<br>AAGCAGAAGAACGGCATCAAGGTGAACTTCAAGATCCGCCACAACATCGAGGACG<br>GCAGCGTGCAGCTCGCCGACCACTACCAGCAGAACACCCCCATCGGCGACGGCCCC<br>GTGCTGCTGCCCGACAACCACTACCTGAGCACCCAGTCCAAGCTGAGCAAAGACCCC<br>AACGAGAAGCGCGATCACATGGTCCTGCTGGAGTTCGTGACCGCCGCCGGGATCAC<br>TCTCGGCATGGACGAGCTGTACAAatgattgtttattgcagcttataatggttacaaataaagcaat<br>agcatcacaaatttcacaaataaagcatttttttcactgcattctagttgtggtttgtccaaactcatcaatgtatc<br>ttatACCTTAGGGCTCGGGATGCTGCTGGCCCTGCCAGGGGCCTTGGGCTCGGGTGG<br>CAGCGCGGAGGACAGCGTGGGCTCCAGCTCTGTCACCGTTGTCctgctgctgctgctgctc<br>ctactgctgGCCACTGGCCTAGCACTGGCCTGGCGCCGCCTCAGCCGTGACTCAGGGG<br>GCTACTACCACCCGGCCCGCCTAGGTGCCGCGCTGTGGGGCCGCACGCGGCGCCTG<br>CTCTGGGCCAGCCCCCCAGGTCGCTGGCTGCAGGCCCGAGCTGAGCTGGGGTCCAC<br>AGACAATGACCTTGAGCGACAGGAGGATGAGCAGGACACAGACTATGACCACGTC<br>GCGGATGGTGGCCTGCAGGCTGACCCTGGGGAAGGCGAGCAGCAATGTGGAGAG<br>GCGTCCAGCCCAGAGCAGGTCCCCGTGCGGGCTGAGGAAGCCAGAGACAGTGACA<br>CG (SEQ ID NO: 160) | |
| pARBI-941:<br>PTPRCAP_2<br>_Endogeno<br>us_44 | aaggtcaggttcagcctcactggggtgaagtttgagcacggtgagcaggccatgcagcccgggggagggggag<br>gatgggaggaggtggagctttccgggcagagggaacagccagtgcgaaggcccaggcaggtggcttaatgc<br>agctgttggggaggtgagtggtagggaggaggctggagggatgggggctgatctcacagggccagagcctg<br>gttgaccaaataaggccttggccttttctGCTTGGCTGTCCCAAGAGGATCCCAAAGAGAAAAA<br>AACGAAAGTGGTCTTGGTCACCCAGCCTGCCCCACACCAGGCCCCACCCCAGGTGCT<br>GAGCCCTCTGAGCCCTGCCTGTCTCCCACAGGCTCTGCCCTGCACCTTAGGGCTCG<br>GGATGCTGCTGGCCCTGCCAGGGGCCTTGGGCTCGGGTGGCAGCGCGGAGGACAG<br>CtccggatccggagagggcaggggatctctccttacttgtggcgacgtggaggagaaccccggccccATGG<br>TGAGCAAGGGCGAGGAGCTGTTCACCGGGGTGGTGCCCATCCTGGTCGAGCTGGA<br>CGGCGACGTAAACGGCCACAAGTTCAGCGTGTCCGGCGAGGGCGAGGGCGATGCC<br>ACCTACGGCAAGCTGACCCTGAAGTTCATCTGCACCACCGGCAAGCTGCCCGTGCCC<br>TGGCCCACCCTCGTGACCACCCTGACCTACGGCGTGCAGTGCTTCAGCCGCTACCCC<br>GACCACATGAAGCAGCACGACTTCTTCAAGTCCGCCATGCCCGAAGGCTACGTCCAG<br>GAGCGCACCATCTTCTTCAAGGACGACGGCAACTACAAGACCCGCGCCGAGGTGAA<br>GTTCGAGGGCGACACCCTGGTGAACCGCATCGAGCTGAAGGGCATCGACTTCAAGG<br>AGGACGGCAACATCCTGGGGCACAAGCTGGAGTACAACTACAACAGCCACAACGTC<br>TATATCATGGCCGACAAGCAGAAGAACGGCATCAAGGTGAACTTCAAGATCCGCCA<br>CAACATCGAGGACGGCAGCGTGCAGCTCGCCGACCACTACCAGCAGAACACCCCCA<br>TCGGCGACGGCCCCGTGCTGCTGCCCGACAACCACTACCTGAGCACCCAGTCCAAGC<br>TGAGCAAAGACCCCAACGAGAAGCGCGATCACATGGTCCTGCTGGAGTTCGTGACC<br>GCCGCCGGGATCACTCTCGGCATGGACGAGCTGTACAAatgattgtttattgcagcttataat<br>ggttacaaataaagcaatagcatcacaaatttcacaaataaagcatttttttcactgcattctagttgtggttttgt<br>ccaaactcatcaatgtatcttatGTGGGCTCCAGCTCTGTCACCGTTGTCctgctgctgctgctgctc<br>ctactgctgGCCACTGGCCTAGCACTGGCCTGGCGCCGCCTCAGCCGTGACTCAGGGG<br>GCTACTACCACCCGGCCCGCCTAGGTGCCGCGCTGTGGGGCCGCACGCGGCGCCTG<br>CTCTGGGCCAGCCCCCCAGGTCGCTGGCTGCAGGCCCGAGCTGAGCTGGGGTCCAC<br>AGACAATGACCTTGAGCGACAGGAGGATGAGCAGGACACAGACTATGACCACGTC<br>GCGGATGGTGGCCTGCAGGCTGACCCTGGGGAAGGCGAGCAGCAATGTGGAGAG<br>GCGTCCAGCCCAGAGCAGGTCCCCGTGCGGGCTGAGGAAGCCAGAGACAGTGACA<br>CGGAGGGCGACCTGGTCCTCGGCTCCCCAGGACCAGCGAGCGCAGGGGGCAGTGC<br>TGAGGCCCTGCTGAGT (SEQ ID NO: 161) | 1806 |
| pARBI-942:<br>PTPRCAP_3<br>_Endogeno<br>us_45 | cagtgcgaaggcccaggcaggtggcttaatgcagctgttggggaggtgagtggtagggaggaggctggag<br>ggatgggggctgatctcacagggccagagcctggttgaccaaataaggccttggccttttctGCTTGGCTG<br>TCCCAAGAGGATCCCAAAGAGAAAAAAACGAAAGTGGTCTTGGTCACCCAGCCTGC<br>CCCACACCAGGCCCCACCCCAGGTGCTGAGCCCTCTGAGCCCTGCCTGTCTCCCAC<br>AGGCTCTGCCCTGCACCTTAGGGCTCGGGATGCTGCTGGCCCTGCCAGGGGCCTTG<br>GGCTCGGGTGGCAGCGCGGAGGACAGCGTGGGCTCCAGCTCTGTCACCGTTGTCct<br>gctgctgctgctgctcctactgctgGCCACTGGCCTAGCACTGGCCTGGCGCCGCCTCAGCC<br>TGACTCAGGGGGCTACTACtccggatccggagagggcaggggatctctccttacttgtggcgacgtgg<br>aggagaaccccggccccATGGTGAGCAAGGGCGAGGAGCTGTTCACCGGGGTGGTGCCC<br>ATCCTGGTCGAGCTGGACGGCGACGTAAACGGCCACAAGTTCAGCGTGTCCGGCGA<br>GGGCGAGGGCGATGCCACCTACGGCAAGCTGACCCTGAAGTTCATCTGCACCACCG<br>GCAAGCTGCCCGTGCCCTGGCCCACCCTCGTGACCACCCTGACCTACGGCGTGCAGT<br>GCTTCAGCCGCTACCCCGACCACATGAAGCAGCACGACTTCTTCAAGTCCGCCATGC<br>CCGAAGGCTACGTCCAGGAGCGCACCATCTTCTTCAAGGACGACGGCAACTACAAG | 1806 |

TABLE 5-continued

CONSTRUCTS USED FOR EVALUATION OF PREDICTED LOCI

| Construct name | Sequence | Length |
|---|---|---|
| | ACCCGCGCCGAGGTGAAGTTCGAGGGCGACACCCTGGTGAACCGCATCGAGCTGA<br>AGGGCATCGACTTCAAGGAGGACGGCAACATCCTGGGGCACAAGCTGGAGTACAA<br>CTACAACAGCCACAACGTCTATATCATGGCCGACAAGCAGAAGAACGGCATCAAGG<br>TGAACTTCAAGATCCGCCACAACATCGAGGACGGCAGCGTGCAGCTCGCCGACCAC<br>TACCAGCAGAACACCCCCATCGGCGACGGCCCCGTGCTGCTGCCCGACAACCACTAC<br>CTGAGCACCCAGTCCAAGCTGAGCAAAGACCCCAACGAGAAGCGCGATCACATGGT<br>CCTGCTGGAGTTCGTGACCGCCGCCGGGATCACTCTCGGCATGGACGAGCTGTACA<br>Aatgattgtttattgcagcttataatggttacaaataaagcaatagcatcacaaatttcacaaataaagcatttt<br>tttcactgcattctagttgtggtttgtccaaactcatcaatgtatcttatCACCCGGCCCGCCTAGGTGCC<br>GCGCTGTGGGCCGCACGCGGCGCCTGCTCTGGGCAGCCCCCCAGGTCGCTGGCT<br>GCAGGCCCGAGCTGAGCTGGGGTCCACAGACAATGACCTTGAGCGACAGGAGGAT<br>GAGCAGGACACAGACTATGACCACGTCGCGGATGGTGGCCTGCAGGCTGACCCTG<br>GGGAAGGCGAGCAGCAATGTGGAGAGGCGTCCAGCCCAGAGCAGGTCCCCGTGCG<br>GGCTGAGGAAGCCAGAGACAGTGACACGGAGGGCGACCTGGTCCTCGGCTCCCCA<br>GGACCAGCGAGCGCAGGGGGCAGTGCTGAGGCCCTGCTGAGTGACCTGCACGCCT<br>TTGCTGGCAGCGCAGCCTGGGATGACAGCGCCAGGGCAGCTGGGGGCCAGGGCCT<br>CCATGTCACCGCACTGTAGAGGCCGGTCTTGGTGTCCCATCCC (SEQ ID NO: 162) | |
| pARBI-943:<br>RPS23_1_E<br>ndogenous<br>_46 | ATAGAGTAGGGCGGGGGATGCCATGGAGAGGCTCCATGGGGGAGGGCCGGGGAA<br>GCGCCGCTCCAGGAGGCACGTGGTCCGGCGCGGAAGGGGCCCATGAGGCGTGGA<br>GGCCGCCGAGGTCGGGGTACCGAGGGACGCAGGGAGGCCAGCGCTTCCTCCCGGG<br>CATTCGAGCGGGGCCTCGTCCTTCGGGAGAACACATTCTCCGGAGCCCTCTTCGAAC<br>GTTTATTAGTCGGTTCAGGGCAACTTGAAGGCCAAATGTTTGGCCCACAGGCCAATA<br>AATAGTACGAGAGCCAATCGGCTTAAGGGTTTATTCCAGGTGAGGCGAGTGTCTTA<br>GAAGATGGGAAACACGTAGATGGCGTGTTTTTACGGAAGAACTAAAATATTTAATTT<br>TTAGGCAAGTGTCGTGGACTTCGTACTGCTAGGAAGCTCCGTAGTCACCGACGAGA<br>CCAGtccggatccggagagggcaggggatctctccttacttgtggcgacgtggaggagaaccccggccccA<br>TGGTGAGCAAGGGCGAGGAGCTGTTCACCGGGGTGGTGCCCATCCTGGTCGAGCT<br>GGACGGCGACGTAAACGGCCACAAGTTCAGCGTGTCCGGCGAGGGCGAGGGCGAT<br>GCCACCTACGGCAAGCTGACCCTGAAGTTCATCTGCACCACCGGCAAGCTGCCCGTG<br>CCCTGGCCCACCCTCGTGACCACCCTGACCTACGGCGTGCAGTGCTTCAGCCGCTAC<br>CCCGACCACATGAAGCAGCACGACTTCTTCAAGTCCGCCATGCCCGAAGGCTACGTC<br>CAGGAGCGCACCATCTTCTTCAAGGACGACGGCAACTACAAGACCCGCGCCGAGGT<br>GAAGTTCGAGGGCGACACCCTGGTGAACCGCATCGAGCTGAAGGGCATCGACTTCA<br>AGGAGGACGGCAACATCCTGGGGCACAAGCTGGAGTACAACTACAACAGCCACAA<br>CGTCTATATCATGGCCGACAAGCAGAAGAACGGCATCAAGGTGAACTTCAAGATCC<br>GCCACAACATCGAGGACGGCAGCGTGCAGCTCGCCGACCACTACCAGCAGAACACC<br>CCCATCGGCGACGGCCCCGTGCTGCTGCCCGACAACCACTACCTGAGCACCCAGTCC<br>AAGCTGAGCAAAGACCCCAACGAGAAGCGCGATCACATGGTCCTGCTGGAGTTCGT<br>GACCGCCGCCGGGATCACTCTCGGCATGGACGAGCTGTACAAatgattgtttattgcagctt<br>ataatggttacaaataaagcaatagcatcacaaatttcacaaataaagcatttttttcactgcattctagttgtg<br>gtttgtccaaactcatcaatgtatcttatAAGTGGCATGATAAACAGTATAAGAAAGCTCATTT<br>GGGCACAGCCCTAAAGGCCAACCCTTTTGGAGGTGCTTCTCATGCAAAAGGAATCG<br>TGCTGGAAAAAGTGTAAGTCCATTGCTCCCGTCAAGTTTTAGTTTATTATAGGAATTC<br>GAGACATGAACTTACGAATTCTTGTTTTGAAAGTAATTGCAGGTTTTTGTGTAGTAGT<br>ATTCATTTGGGCATTGTGGGGTAAAATTGCAAAGCGTTTGTTCTATTTAAAAGTTGG<br>TAAAATTAGTTTTTTGGGAATTAGGTAGTTAAGGTTTTAATTTAACGTTGGCCTGGAA<br>GGAATTGGAGAAGATACTAGCAATGATGAAGTAAAGGACACAAACACCTTTACTGT<br>GGGAGTTGTTATAAGTAAATGGCACGTGTCAGCTATTGAACTTTATCGACTTGATAA<br>AACTAAGGTGAAGAGA (SEQ ID NO: 163) | 1806 |
| pARBI-944:<br>RPS23_2_E<br>ndogenous<br>_47_48 | CAAGCGGGACTTGGGGTCTTGGGGACGGGCGGGCGGATGCGAATAGAGTAGGGC<br>GGGGGATGCCATGGAGAGGCTCCATGGGGGAGGGCCGGGGAAGCGCCGCTCCAG<br>GAGGCACGTGGTCCGGCGCGGAAGGGGCCCATGAGGCGTGGAGGCCGCCGAGGT<br>CGGGGTACCGAGGGACGCAGGGAGGCCAGCGCTTCCTCCCGGGCATTCGAGCGGG<br>GCCTCGTCCTTCGGGAGAACACATTCTCCGGAGCCCTCTTCGAACGTTTATTAGTCG<br>GTTCAGGGCAACTTGAAGGCCAAATGTTTGGCCCACAGGCCAATAAATAGTACGAG<br>AGCCAATCGGCTTAAGGGTTTATTCCAGGTGAGGCGAGTGTCTTAGAAGATGGGAA<br>ACACGTAGATGGCGTGTTTTTACGGAAGAACTAAAATATTTAATTTTTAGGCAAGTG<br>CCGCGGAtccggatccggagagggcaggggatctctccttacttgtggcgacgtggaggagaaccccggcc<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcatttttttcactgcattctagttg<br>tggtttgtccaaactcatcaatgtatcttatCTTCGTACTGCTAGGAAGCTCCGTAGTCACCGAC | 1806 |

TABLE 5-continued

CONSTRUCTS USED FOR EVALUATION OF PREDICTED LOCI

| Construct name | Sequence | Length |
| --- | --- | --- |
| | GAGACCAGAAGTGGCATGATAAACAGTATAAGAAAGCTCATTTGGGCACAGCCCTA<br>AAGGCCAACCCTTTTGGAGGTGCTTCTCATGCAAAAGGAATCGTGCTGGAAAAAGT<br>GTAAGTCCATTGCTCCCGTCAAGTTTTAGTTTATTATAGGAATTCGAGACATGAACTT<br>ACGAATTCTTGTTTTGAAAGTAATTGCAGGTTTTTGTGTAGTAGTATTCATTTGGGCA<br>TTGTGGGGTAAAATTGCAAAGCGTTTGTTCTATTTAAAAGTTGGTAAAATTAGTTTTT<br>GGGAATTAGGTAGTTAAGGTTTTAATTTAACGTTGGCTGGAAGGAATTGGAGAAG<br>ATACTAGCAATGATGAAGTAAAGGACACAAACACCTTTACTGTGGGAGTTGTTATAA<br>GTAAATGGCACGTGTCA (SEQ ID NO: 164) | |
| pARBI-945:<br>RTRAF_1_<br>ndogenous<br>_49 | TTGTATATCCTTTTTAAAGTTATTCTTTTTAGTTAATTGCTCTATGTGTATTGAGACTA<br>EGGAATCAGAAAGCTTAGATTCTAGTCCCAGGTGTAAGTTGTGTAACCCTTGGCAAGT<br>GTCAATCTCTAGGCCTCAGCTTTCTCATCTATAAAATGAGGAAGTTGTCGTATTCTAT<br>TTTTTTTCTTAAGATGATACACTTAAATGTTCCCTTCTGTTGGGTTATATAATTGCATC<br>AAAAGTGTAGTAATGTTATTAAAAAATTGTTAGAGATCCAAACTAAGGTCTCTTTCA<br>ACTCTCCCATTCTTTTTTCTGTGACTTTATGGTAATAATGAAACTGGTGGTTTTCTTTT<br>CTTCCCCCCTCACAGTATCTCAGAGATGTTAACTGTCCTTTCAAGATTCAAGATCGACA<br>AGAAGCTATTGACTGGCTTCTTGGTTTAGCTGTTAGACTTGAAtccggatccggagagggc<br>aggggatctctccttacttgtggcgacgtggaggagaaccccggccccATGGTGAGCAAGGGCGAGG<br>AGCTGTTCACCGGGGTGGTGCCCATCCTGGTCGAGCTGGACGGCGACGTAAACGGC<br>CACAAGTTCAGCGTGTCCGGCGAGGGCGAGGGCGATGCCACCTACGGCAAGCTGA<br>CCCTGAAGTTCATCTGCACCACCGGCAAGCTGCCCGTGCCCTGGCCCACCCTCGTGA<br>CCACCCTGACCTACGGCGTGCAGTGCTTCAGCCGCTACCCCGACCACATGAAGCAGC<br>ACGACTTCTTCAAGTCCGCCATGCCCGAAGGCTACGTCCAGGAGCGCACCATCTTCT<br>TCAAGGACGACGGCAACTACAAGACCCGCGCCGAGGTGAAGTTCGAGGGCGACAC<br>CCTGGTGAACCGCATCGAGCTGAAGGGCATCGACTTCAAGGAGGACGGCAACATCC<br>TGGGGCACAAGCTGGAGTACAACTACAACAGCCACAACGTCTATATCATGGCCGAC<br>AAGCAGAAGAACGGCATCAAGGTGAACTTCAAGATCCGCCACAACATCGAGGACG<br>GCAGCGTGCAGCTCGCCGACCACTACCAGCAGAACACCCCCATCGGCGACGGCCCC<br>GTGCTGCTGCCCGACAACCACTACCTGAGCACCCAGTCCAAGCTGAGCAAAGACCCC<br>AACGAGAAGCGCGATCACATGGTCCTGCTGGAGTTCGTGACCGCCGCCGGGATCAC<br>TCTCGGCATGGACGAGCTGTACAAatgattgtttattgcagcttataatggttacaaataaagcaat<br>agcatcacaaatttcacaaataaagcattttttttcactgcattctagttgtggtttgtccaaactcatcaatgtatc<br>ttatTATGGAGATAATGGTACGTTTTGTGGGGAATGTGTATTTTAAAGAGAGAGGAA<br>AGATGGGAAAGGGAGTGTGAAAATGTAGGGAACTTTGCAGTTTGTTTTGTCTAGTA<br>CTATTTTACCTTTGGTTTATTCTTATCACAAGTTAAAAGCACTTTTATTGTCTTTCATTG<br>GTGTTTATATATTTCTGTTAGAATTTGGAAATGGTGCCCTCTGGAGAAGGCTAATTG<br>ACTGTCTTCTCACAGAGTAACACTACTTTGATAATATGGTCTGCACCTTAGCCTTTCA<br>AATTAAATTGTTTTTAGTGTCCCAGAATTGATGGGACTTTGAAGTGTTGTTGCAGTA<br>GGTAATTTCTCAAAAGACTGAAACATGTCTAATGCCAATATACATTAATACTCTATAG<br>GCCAGAATATATTACTTATGTTTACTGTCTTAGCACAGATACTTCTATGGT (SEQ ID<br>NO: 165) | 1806 |
| pARBI-946:<br>RTRAF_2_E<br>ndogenous<br>_50 | GCACCTGTTATGTAGGAGGAGTAATAAAATGAATGAATGCACTCAAAACACTAAAC<br>AGTAATTCTGTAATCCAACGGGAGGTACAGCGAATACCAAAAGCCTACATATACTAT<br>TCTCTGCATGCTATAGCAAGAAAAGAAAAGGAAAGTGGCTTCCCGGTGGTTTTCTGCCT<br>ATTGTACAACCAGGAAGCTGACAATAAAGTTTATTTGAGCGTCGACGTGCGCCGAC<br>GTGGCCCCGCCTCCCAGCCGGAGCCGCGATTGGTGGGCATTTGCCGGCGGCCACC<br>GCTTTTAAGCCACGATTGGCGAAGGCCGCCGTCATTTCGGAGCGACTCAGCGCCTGC<br>CCGCCCTCTCGCCGCGTCGCCGGTGCCTGCGCCTCCCGCTCCACCTCGCTTCTTCT<br>CCCGGCCGAGGCCCGGGGGACCAGAGCGAGAAGCGGGGACCATGTTCCGACGCtcc<br>ggatccggagagggcaggggatctctccttacttgtggcgacgtggaggagaaccccggccccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttttcactgcattctagttgtggtttgtcc<br>aaactcatcaatgtatcttatAAGTTGACGGCTCTCGACTACCACAACCCCGGCTTCAA<br>CTGCAAAGGTGAGGCGGCGGCCTCAGCCCGGCCGCGTGTCCCTGACCTGGGCGGA<br>GGTCCCAGCCTCAGTGCCCGACACCCACCTCCCCGTCGGGACCCTCGGCGGCCTGGT<br>TTCCGCCGGCAGCCTCCGGGCCCCTCTCCTCTGGGTCGCCACGTACCTCGGCTCTTCG<br>CCGCCCCTTCCCGCCTTTAAAGCCCTCTCACCTACTCCTGTCTCGGCATGTTACTTTCT<br>GCACTTGCTTAACTCCAAGCATCACGTAACTACCTTCTCTGTACATAAAAGGGAGAG<br>CATTCGTCTTTCTCACTCACTATTCAACTCCATGGTTCCCTGGGTAATTAGGCGATACC<br>TTGAGCACCTGCTAATTATGGGCCAGCGCGGTGCTGGATTCTGAGGAAGGTGCTGA<br>GTAACTTG (SEQ ID NO: 166) | 1806 |

TABLE 5-continued

CONSTRUCTS USED FOR EVALUATION OF PREDICTED LOCI

| Construct name | Sequence | Length |
|---|---|---|
| pARBI-947: RTRAF_3_Endogenous_51 | CACTAAACAGTAATTCTGTAATCCAACGGGAGGTACAGCGAATACCAAAAGCCTACA<br>TATACTATTCTCTGCATGCTATAGCAAGAAAGAAAGGAAAGTGGCTTCCCGGTGGTT<br>TTCTGCCTATTGTACAACCAGGAAGCTGACAATAAAGTTTATTTGAGCGTCGACGTG<br>CGCCGACGTGGCCCCGCCTCCCCAGCCGGAGCCGCGATTGGTGGGCATTTGCCGGC<br>GGCCACCGCTTTTAAGCCACGATTGGCGAAGGCCGCCGTCATTTCGGAGCGACTCA<br>GCGCCTGCCCGCCCTCTCGCCGCGTCGCCGGTGCCTGCGCCTCCCGCTCCACCTCGC<br>TTCTTCTCTCCCGGCCGAGGCCCGGGGGACCAGAGCGAGAAGCGGGGACCATGTTC<br>CGACGCAAGTTGACGGCTCTCGACTACCACAACCCCGCCGGCTTCAACTGCAAAtccg<br>gatccggagagggcaggggatctctccttacttgtggcgacgtggaggagaaccccggccccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAtgattgtttattgcagcttataatgg<br>ttacaaataaagcaatagcatcacaaatttcacaaataaagcattttttcactgcattctagttgtggtttgtcc<br>aaactcatcaatgtatcttatGGTGAGGCGGCGGCCTCAGCCCGCGCGTGTCCCTGACCT<br>GGGCGGAGGTCCCAGCCTCAGTGCCCGCACCCCACCTCCCCGTCGGGACCCTCGGC<br>GGCCTGGTTTCCGCCGGCAGCCTCCGGGCCCCTCTCCTCTGGGTCGCCACGTACCTC<br>GGCTCTTCGCCGCCCTTCCCGCCTTTAAAGCCCTCTCACCTACTCCTGTCTCGGCATG<br>TTACTTTCTGCACTTGCTTAACTCCAAGCATCTAACTTCTCTGTACATAAAA<br>GGGAGAGCATTCGTCTTTCTCACTCACTATTCAACTCCATGGTTCCCTGGGTAATTAG<br>GCGATACCTTGAGCACCTGCTAATTATGGGCCAGCGCGGTGCTGGATTCTGAGGAA<br>GGTGCTGAGTAACTTGAAGACTAGTTCACTGCCTGCCAGGAGCTAAAGGGACGAGG<br>GGTGGAAG (SEQ ID NO: 167) | 1806 |
| pARBI-948: SERF2_1_Endogenous_52 | CCGGGTTAGGCATAGGCCCTCCCGGATCTTCCGCGGTGTAAGGAGAAGGCCAGCGC<br>CCCTGTGATAGGCCCAGAGCCCCCACTCCACAAGCCAGCCCATCCCCCACGGAGACC<br>CAAACCGTCCACACACACCTTGCCAGCTGTTTGGGCCCCACGCCGCCCCAAAACACG<br>CCTCCAGCTGGCCCCTTGGGACCTCCCTTCTCTAGTCCGTATTTTGACCTGGCCGTG<br>GCAGATTCGCCACTCCCCCCTACCCCAAGCAGCCTGGGCCTCGATGGGCCGTTGTCG<br>GGGCCCGGAGATTGAAGTGGTGTTGGATCCTGCTGCTGGCCGCGCTGGGGTAGAA<br>GGGTCGCCGGTGTGTGGGCAGAGCGGCCCCCGCGTCTCACCTTTAATTTTCTTTCCT<br>TAGGCGGTAACCAGCGTGAGCTCGCCCGCCAGAAGAATATGAAAAAGCAGAGCtcc<br>ggatccggagagggcaggggatctctccttacttgtggcgacgtggaggagaaccccggccccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAtgattgtttattgcagcttataatgg<br>ttacaaataaagcaatagcatcacaaatttcacaaataaagcattttttcactgcattctagttgtggtttgtcc<br>aaactcatcaatgtatcttatGACTCGGTTAAGGGAAAGCGCCGAGATGACGGGCTTTCTG<br>CTGCCGCCCGCAAGCAGAGGTAGCCCCAGGGAGGGAGGGAAAGGGACGGTGGA<br>GACCTGGGTTAGACCAAGGGTTATAGAAGGAAAGAGAGCTACCTCAGGGCTTGAAT<br>GTGGACTAGTCGTGAGGAGCAGAGTGCATTGCTTCCTCTAGGGTTTTATTTCCTCCC<br>CACCCCTCCAAATTGTTAGCTCACAGCCTTACAGGAAAGGACGGGGCGGGCGCCTG<br>CCCTCAGTCTGATTTCTGAGCGTCCCTGGGTCTGACCTTAAGGGCAAGGGCAGGGA<br>GCTTCACATTTCAAATACAGTTGTGGTTACGGCAGCCCAGTACTTTTGGCCCTCCTTG<br>CTGTTCGGTTCTCCTCCCTTCTCCCAACCTCCTCACTGGTGTTGCTGGGTGTGGTCCTC<br>AATACAGAATAGAG (SEQ ID NO: 168) | 1806 |
| pARBI-949: SERF2_2_Endogenous_53_54 | AATCGAGCCCTTTGCCCACGGCTACTTCACGGGACCACCCTCCCGGGTTAGGCATAG<br>GCCCTCCCGGATCTTCCGCGGTGTAAGGAGAAGGCCAGCGCCCTGTGATAGGCCC<br>AGAGCCCCCACTCCACAAGCCAGCCCATCCCCCACGGAGACCCAAACCGTCCACACA<br>CACCTTGCCAGCTGTTTGGGCCCCACGCCGCCCCAAAACACGCCTCCAGCTGGCCCC<br>TTGGGACCTCCCTTCTCTAGTCCGTATTTTGACCTGGCCCGTGGCAGATTCGCCACTC<br>CCCCCTACCCCAAGCAGCCTGGGCCTCGATGGGCCGTTGTCGGGGCCCGGAGATTG<br>AAGTGGTGTTGGATCCTGCTGCTGGCCGCGCTGGGGTAGAAGGGTCGCCGGTGTGT<br>GGGCAGAGCGGCCCCCGCGTCTCACCTTTAATTTTCTTTCCTTAGGCGGTAACtccga<br>tccggagagggcaggggatctctccttacttgtggcgacgtggaggagaaccccggccccATGGTGAGCA | 1806 |

TABLE 5-continued

CONSTRUCTS USED FOR EVALUATION OF PREDICTED LOCI

| Construct name | Sequence | Length |
|---|---|---|
| | AGGGCGAGGAGCTGTTCACCGGGGTGGTGCCCATCCTGGTCGAGCTGGACGGCGA<br>CGTAAACGGCCACAAGTTCAGCGTGTCCGGCGAGGGCGAGGGCGATGCCACCTAC<br>GGCAAGCTGACCCTGAAGTTCATCTGCACCACCGGCAAGCTGCCCGTGCCCTGGCC<br>ACCCTCGTGACCACCCTGACCTACGGCGTGCAGTGCTTCAGCCGCTACCCCGACCAC<br>ATGAAGCAGCACGACTTCTTCAAGTCCGCCATGCCCGAAGGCTACGTCCAGGAGCG<br>CACCATCTTCTTCAAGGACGACGGCAACTACAAGACCCGCGCCGAGGTGAAGTTCG<br>AGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATA<br>TCATGGCCGACAAGCAGAAGAACGGCATCAAGGTGAACTTCAAGATCCGCCACAAC<br>ATCGAGGACGGCAGCGTGCAGCTCGCCGACCACTACCAGCAGAACACCCCCATCGG<br>CGACGCCCCCGTGCTGCTGCCCGACAACCACTACCTGAGCACCCAGTCCAAGCTGA<br>GCAAAGACCCCAACGAGAAGCGCGATCACATGGTCCTGCTGGAGTTCGTGACCGCC<br>GCCGGGATCACTCTCGGCATGGACGAGCTGTACAAatgattgtttattgcagcttataatggtt<br>acaaataaagcaatagcatcacaaatttcacaaataaagcattttttcactgcattctagtttgtggtttgtccaa<br>actcatcaatgtatcttatCAGCGCGAGCTTGCCCGCCAGAAGAATATGAAAAAGCAGAGC<br>GACTCGGTTAAGGGAAAGCGCCGAGATGACGGGCTTTCTGCTGCCGCCCGCAAGCA<br>GAGGTAGCCCCAGGGAGGGGAGGGAAAGGGACGGTGGAGACCTGGGTTAGACCA<br>AGGGTTATAGAAGGAAAGAGAGCTACCTCAGGGCTTGAATGTGGACTAGTCGTGA<br>GGAGCAGAGTGCATTGCTTCCTCTAGGGTTTTATTTCCTCCCCACCCTCCAAATTGTT<br>AGCTCACAGCCTTACAGGAAAGGACGGGGGCGGGCGCCTGCCCTCAGTCTGATTTC<br>TGAGCGTCCCTGGGTCTGACCTTAAGGGCAAGGGCAGGGAGCTTCACATTTCAAAT<br>ACAGTTGTGGTTACGGCAGCCCAGTACTTTTGGCCCTCCTTGCTGTTCGGTTCTCCTC<br>CCTTCTCCCAACCTC (SEQ ID NO: 169) | |
| pARB1-950:<br>SLC38A1_1<br>_Endogeno<br>us_55 | TTCAAAAGGAATCTTTTTGTTTCAACTATTAGGATCTTTTTAAATCAAATATGTATTTT<br>AATGGTGTACACCAGACCTGAAGAAAAAGATCACAGAAGGAATTTCCCCMGTAA<br>GATAGAGGTAGTTAAAAATAAGCCTTATGACCTAATAGGTTAATTGTAATGCTCTGG<br>TAGCCAACTTGAAAAAGGAGAAATGATGGTTGCATCTCACATTTTAAAATGTTAAGA<br>ATTTGTTTTGTAATGAGGATACCTTAACCCCTGAAGGCCAAAATGACTATTTGTGTGA<br>GTTTGAGAAAGGCACATAGTAACTTGGGGAACAGTCAATAGAATGACAAAATCTTG<br>ACTATTTTAACTTTCTGAACCCTGTCATTTCTTGTGTTCTCAAATTTGATTTTTAAATAG<br>GCTGCATGGTGTATGAAAAGCTGGGGGAACAAGTCTTTGGCACCACAtccggatccgga<br>gagggcaggggatctctccttacttgtggcgacgtggaggagaaccccggccccATGGTGAGCAAGGG<br>CGAGGAGCTGTTCACCGGGGTGGTGCCCATCCTGGTCGAGCTGGACGGCGACGTAA<br>ACGGCCACAAGTTCAGCGTGTCCGGCGAGGGCGAGGGCGATGCCACCTACGGCAA<br>GCTGACCCTGAAGTTCATCTGCACCACCGGCAAGCTGCCCGTGCCCTGGCCCACCCT<br>CGTGACCACCCTGACCTACGGCGTGCAGTGCTTCAGCCGCTACCCCGACCACATGAA<br>GCAGCACGACTTCTTCAAGTCCGCCATGCCCGAAGGCTACGTCCAGGAGCGCACCAT<br>CTTCTTCAAGGACGACGGCAACTACAAGACCCGCGCCGAGGTGAAGTTCGAGGGCG<br>ACACCCTGGTGAACCGCATCGAGCTGAAGGGCATCGACTTCAAGGAGGACGGCAAC<br>ATCCTGGGGCACAAGCTGGAGTACAACTACAACAGCCACAACGTCTATATCATGGCC<br>GACAAGCAGAAGAACGGCATCAAGGTGAACTTCAAGATCCGCCACAACATCGAGGA<br>CGGCAGCGTGCAGCTCGCCGACCACTACCAGCAGAACACCCCCATCGGCGACGGCC<br>CCGTGCTGCTGCCCGACAACCACTACCTGAGCACCCAGTCCAAGCTGAGCAAAGACC<br>CCAACGAGAAGCGCGATCACATGGTCCTGCTGGAGTTCGTGACCGCCGCCGGGATC<br>ACTCTCGGCATGGACGAGCTGTACAAatgattgtttattgcagcttataatggttacaaataaagca<br>atagcatcacaaatttcacaaataaagcattttttcactgcattctagtttgtggtttgtccaaactcatcaatgta<br>tcttatGGGAAGTTCGTAATCTTTGGAGCCACCTCTCTACAGAACACTGGAGGTAAAA<br>AGAACATGCTTTTCTTTACATAACTTGAAACTAATTCTTGGTGGATGAGCGGCCACAT<br>GAATTTTAACATAATTCAAGCAGTTATCATCCTCATTGCTAAAATGGCACAGGGAAA<br>GTAAAGCAGAGACAGCAGTCACTTATTTAAAGCCACAAATCCTGCTAGAGTAGCTGA<br>AGTTGCCTTTGTGTCTTACTGACAGTTGGTCTAAGAACGGGCTGATAACTTTTTATGT<br>AGCTGCAACATAAGCCTTCGTATCTTTCTTTCTAAAAATGTTCTCATTTTCCTTCAGCA<br>ATGCTGAGCTACCTCTTCATCGTAAAAAATGAACTACCCTCTGCCATAAAGTTTCTAA<br>TGGGAAAGGAAGAGACATTTTCGTAAGTTATAGACCATTTTTTTATGATATA (SEQ<br>ID NO: 170) | 1806 |
| pARBI-951:<br>SLC38A1_2<br>_Endogeno<br>us_56_57 | TAAAGATGTCAAGCTTCAAATCATTATCATAAGGTTAAATATATTACGCATGTCTTTA<br>CAGCAAGTTTATTTCTGATCGTGAAAGTAGAAGAAGTCTCACAAACAGCCATTTGGA<br>AAAAAGAAGTGTGATGAGTATGTAAGTATCATTATAATGAAGTATGCTTATTTTTTT<br>AATCATATAAATTGGGACAAATCTTTTTAATTCAAGTAGCATAGTACCAAAAGCATA<br>ACTACCTGTATTCACCAGGATATTCCTCATACCTTATGTATTTTCTCTTGAAATCCATT<br>CAAGGAAATAACTAGATAACTAAGAATGGATTTTCTTGAATTTTACTTCCATATTGGT<br>TCCTGAGAGTGCATTAAAGGCTTTGGCTTGATGAACTTTCTTGGGGATTATTTTGCTT<br>AGTGTCAATGTTTGTTTCTTTGTTCAGATTCCAGGTACAACCTCCtccggatccggagaggg<br>caggggatctctccttacttgtggcgacgtggaggagaaccccggccccATGGTGAGCAAGGGCGAG<br>GAGCTGTTCACCGGGGTGGTGCCCATCCTGGTCGAGCTGGACGGCGACGTAAACGG<br>CCACAAGTTCAGCGTGTCCGGCGAGGGCGAGGGCGATGCCACCTACGGCAAGCTG<br>ACCCTGAAGTTCATCTGCACCACCGGCAAGCTGCCCGTGCCCTGGCCCACCCTCGTG<br>ACCACCCTGACCTACGGCGTGCAGTGCTTCAGCCGCTACCCCGACCACATGAAGCAG<br>CACGACTTCTTCAAGTCCGCCATGCCCGAAGGCTACGTCCAGGAGCGCACCATCTTC<br>TTCAAGGACGACGGCAACTACAAGACCCGCGCCGAGGTGAAGTTCGAGGGCGACA<br>CCCTGGTGAACCGCATCGAGCTGAAGGGCATCGACTTCAAGGAGGACGGCAACATC<br>CTGGGGCACAAGCTGGAGTACAACTACAACAGCCACAACGTCTATATCATGGCCGA<br>CAAGCAGAAGAACGGCATCAAGGTGAACTTCAAGATCCGCCACAACATCGAGGACG | 1806 |

TABLE 5-continued

CONSTRUCTS USED FOR EVALUATION OF PREDICTED LOCI

| Construct name | Sequence | Length |
|---|---|---|
| | GCAGCGTGCAGCTCGCCGACCACTACCAGCAGAACACCCCCATCGGCGACGGCCCC<br>GTGCTGCTGCCCGACAACCACTACCTGAGCACCCAGTCCAAGCTGAGCAAAGACCCC<br>AACGAGAAGCGCGATCACATGGTCCTGCTGGAGTTCGTGACCGCCGCCGGGATCAC<br>TCTCGGCATGGACGAGCTGTACAAatgattgttttattgcagcttataatggttacaaataaagcaat<br>agcatcacaaatttcacaaataaagcatttttttcactgcattctagttgtggtttgtccaaactcatcaatgtatc<br>ttatTTAGGCATGTCAGTTTTTAACCTAAGCAACGCCATTATGGGCAGTGGGATTTTG<br>GGACTCGCCTTTGCCCTGGCAAACACTGGAATCCTACTTTTTCTGTGAGTATTGACGT<br>GCCGGTACTTTCCATTTTAAAACTGAACTTTTTGTATGTTTCTGTTATTACATAGAAGA<br>AATGTGAAATATTTATAAATAGTTTTTTTATTAACTTGGCTAAGTTACAAGTACATAC<br>TTTGATATTTATTGCTTGAGTGATTTTCCAAACTGTACCTAATGCTTACAACAAAGAG<br>GAAGGAGAAATCTTTTTATTAATCAAAATACTGAAATAAGCATTTGTGAAAAGGA<br>TTAAAACATTTGAAAATAACTTTTTTTGGTATTTTTGGAGTCTACCTGTGACTTTAAAT<br>CTCAGTTAAAATATTAAGAGGTGTTTAACCCCAGCCAGTCACCACTT (SEQ ID NO: 171) | |
| pARBI-952:<br>SMAD2_1_<br>Endogenou<br>s_58 | ATCATTCTTCACACTAGTTCCTTTTCTGACTCTTCAGTCACCTCCAGAATTAATATCCTT<br>AGAAGCATCTCTAAAATGAGTTTGATTTACTAAACATAGAAGTTGACAAAGTTTTTC<br>AAGTATAACTGCATAAACTCTCTTTTTTAAAAAATCAGTTTTTCCCAAGTTGTTAGCCT<br>TTCATTGGCATTTGAGTCATTTATGTGACATATTTATAAGAAACATCTGCTAGTGCTG<br>CTGCATACTTTTATCAGATCCATTAAATAGTACATTTTTGTTCTTGATTCTCACTAAAA<br>CTAACTAAATGGCTGTCATTCTTTTCTTTATGCTTTTATTGTACTAATTTAGCCCATTTG<br>ACTGCACTtttttttttttttttttttAAAGTTCCCTCCTTTCTTTTCCCCTTGCTTCCCAACAGGTC<br>TCTTGATGGTCGTCTCCAGGTATCCCATCGAtccggatccggagagggcaggggatctctcctta<br>cttgtggcgacgtggaggagaaccccggccccATGGTGAGCAAGGGCGAGGAGCTGTTCACCG<br>GGGTGGTGCCCATCCTGGTCGAGCTGGACGGCGACGTAAACGGCCACAAGTTCAGC<br>GTGTCCGGCGAGGGCGAGGGCGATGCCACCTACGGCAAGCTGACCCTGAAGTTCAT<br>CTGCACCACCGGCAAGCTGCCCGTGCCCTGGCCCACCCTCGTGACCACCCTGACCTA<br>CGGCGTGCAGTGCTTCAGCCGCTACCCCGACCACATGAAGCAGCACGACTTCTTCAA<br>GTCCGCCATGCCCGAAGGCTACGTCCAGGAGCGCACCATCTTCTTCAAGGACGACG<br>GCAACTACAAGACCCGCGCCGAGGTGAAGTTCGAGGGCGACACCCTGGTGAACCG<br>CATCGAGCTGAAGGGCATCGACTTCAAGGAGGACGGCAACATCCTGGGGCACAAG<br>CTGGAGTACAACTACAACAGCCACAACGTCTATATCATGGCCGACAAGCAGAAGAA<br>CGGCATCAAGGTGAACTTCAAGATCCGCCACAACATCGAGGACGGCAGCGTGCAGC<br>TCGCCGACCACTACCAGCAGAACACCCCCATCGGCGACGGCCCCGTGCTGCTGCCCG<br>ACAACCACTACCTGAGCACCCAGTCCAAGCTGAGCAAAGACCCCAACGAGAAGCGC<br>GATCACATGGTCCTGCTGGAGTTCGTGACCGCCGCCGGGATCACTCTCGGCATGGA<br>CGAGCTGTACAAAatgattgttttattgcagcttataatggttacaaataaagcaatagcatcacaaatttca<br>caaataaagcattttttcactgcattctagttgtggtttgtccaaactcatcaatgtatcttatAAAGGATTG<br>CCACATGTTATATATTGCCGATTATGGCGCTGGCCTGATCTTCACAGTCATCATGAAC<br>TCAAGGCAATTGAAAACTGCGAATATGCTTTTAATCTTAAAAAGGATGAAGTATGTG<br>TAAACCCTTACCACTATCAGAGAGTTGAGCACCAGGTAGGAATATTGCAAGTTTTT<br>TCTTGGTTTTGAATTAAATGCCTGAACTTCAGTATATTTAAGTACTCTTGTGACCCA<br>GGAAAATTTTAGTGTAAATTCTAATAAATTACCTTAAATTGTGCATATTATTTGGTGG<br>TAATTAAAAttttttttattttttaaaaattttttAATGAGAAAACATATCTGTTTCTTGGAATAGCA<br>TATGATTTGGCATGAAAGTGCATATCCAGGAAATCCTGTAGATTGGCAGTCTGCTCA<br>GCGCTATGCTGATGTGCTTCTACATGTCCCT (SEQ ID NO: 172) | 1806 |
| pARBI-953:<br>SMAD2_2_<br>Endogenou<br>s_59 | TTCTATATTAAAAATCAGTTGACATCTGTTTTAGATAATTTTTTAAAAAACTGGATTA<br>TAAAATGAAGCACTTAGTAAAGCTGATGGCAGAGGTTTTAGATCTTTTGAATACAGG<br>AAAGTGGTAAGGGCATTATAGGTATGATTCATTGAGCTAGAGGGCGTTGGTGTTCA<br>CATTTTAAAAACATAATCATGACTTATCTGGAGTCACATGTTCCATTTTATTGGCTTCC<br>TTCATATAGAAAATATAGTAACCAGCACTACATGCCTGTGAAAAAGTGAAGCAATTG<br>TATATTTTCTGGGTGAAGGAAGTATTCTGTACATTCTCCATGTTTTACATCATGGTATT<br>TTGAATAACCATGCTTCCATGTTCACATCAATTTTTTGTTTTTCAATTTATGCACAGCA<br>CTTGCTCTGAAATTTGGGGACTGAGTACACCAAATACGATAGATtccggatccggagagg<br>gcaggggatctctccttacttgtggcgacgtggaggagaaccccggccccATGGTGAGCAAGGGCGA<br>GGAGCTGTTCACCGGGGTGGTGCCCATCCTGGTCGAGCTGGACGGCGACGTAAACG<br>GCCACAAGTTCAGCGTGTCCGGCGAGGGCGAGGGCGATGCCACCTACGGCAAGCT<br>GACCCTGAAGTTCATCTGCACCACCGGCAAGCTGCCCGTGCCCTGGCCCACCCTCGT<br>GACCACCCTGACCTACGGCGTGCAGTGCTTCAGCCGCTACCCCGACCACATGAAGCA<br>GCACGACTTCTTCAAGTCCGCCATGCCCGAAGGCTACGTCCAGGAGCGCACCATCTT<br>CTTCAAGGACGACGGCAACTACAAGACCCGCGCCGAGGTGAAGTTCGAGGGCGAC<br>ACCCTGGTGAACCGCATCGAGCTGAAGGGCATCGACTTCAAGGAGGACGGCAACAT<br>CCTGGGGCACAAGCTGGAGTACAACTACAACAGCCACAACGTCTATATCATGGCCG<br>ACAAGCAGAAGAACGGCATCAAGGTGAACTTCAAGATCCGCCACAACATCGAGGAC<br>GGCAGCGTGCAGCTCGCCGACCACTACCAGCAGAACACCCCCATCGGCGACGGCCCC<br>GTGCTGCTGCCCGACAACCACTACCTGAGCACCCAGTCCAAGCTGAGCAAAGACCCC<br>AACGAGAAGCGCGATCACATGGTCCTGCTGGAGTTCGTGACCGCCGCCGGGATCA<br>CTCTCGGCATGGACGAGCTGTACAAatgattgttttattgcagcttataatggttacaaataaagcaa<br>tagcatcacaaatttcacaaataaagcattttttcactgcattctagttgtggtttgtccaaactcatcaatgtat<br>cttatCAGTGGGATACAACAGGCCTTTCAGCTTGTGAACAAACCAGGTGAATATTC<br>TGCCCTCTGTCGAATCTTAGAGATCTTGTGGAGGGGGTATATTTTGAAAGACCTA<br>TATGGGGTTGCTTAGTATAATMGCCTAGGATGTTTCCTTAATGTAAAATAAGGCAT<br>AGCATTTAAAATATCTGCTTGCCAGTATAAAAAATATATTAAATGTTTCAGCTGATGT<br>TTTAATCAATGCAATTCTAGTTTGAATCTTCTTTAAATTACTGTATCCCCTAAAGAATA | 1806 |

TABLE 5-continued

CONSTRUCTS USED FOR EVALUATION OF PREDICTED LOCI

| Construct name | Sequence | Length |
|---|---|---|
| | ATAATTTTGATAACTATATATTTATTTTAGCTTGAGATCAGATTATAATCTGTTGTTGG<br>CCTAATTTTTAAGTAGATACATGATGAGTTTTGCTAAATTTCTTGTTATCAGAATCTCA<br>TCTTTATACTAATAAATACATACTTAATGAACCCCTTATATCACAA (SEQ ID NO: 173) | |
| pARBI-954:<br>SMAD2_3_<br>Endogenou<br>s_60 | TCAATGTATTTTTGTATAGTCTTTTGAGATTAGAGTGAAGTTCTAAAAAGTAAGAGA<br>ACCTTTTGTGAAAATATTTTAATTGACACTACTAAGAGTTTAAAATAGTATTGGTGGT<br>GAAAAATCGTTAAAAGTATCTGATTTTACTTGCAAAATTACTGTATTTTCCCACAAGA<br>GGAGTCCTTACAACATTCTTGTTTTTAGAAGGGTTTGTTTCCATCATTCATTTAAATTC<br>ATAAAGATAACGTTTTCATGGGTGGAGAAGTCTATTGGGAAAGTCATAATTCGAATT<br>TCTATCTTGCTTTGCAGTTTGCTTTCTATGATAAGTTGAAATTATTACTTGATGTTCAA<br>GGTAGTCTCTACATCATCCTTTCAATATTTCTGCTAGGTTCGATACAAGAGGCTGTTT<br>TCCTAGCGTGGCTTGCTGCCTTTGGTAAGAACATGTCGTCGATCtccggatccggagagggg<br>cagggggatctctccttacttgtggcgacgtggaggagaaccccggccccATGGTGAGCAAGGGCGAG<br>GAGCTGTTCACCGGGGTGGTGCCCATCCTGGTCGAGCTGGACGGCGACGTAAACGG<br>CCACAAGTTCAGCGTGTCCGGCGAGGGCGAGGGCGATGCCACCTACGGCAAGCTG<br>ACCCTGAAGTTCATCTGCACCACCGGCAAGCTGCCCGTGCCCTGGCCCACCCTCGTG<br>ACCACCCTGACCTACGGCGTGCAGTGCTTCAGCCGCTACCCCGACCACATGAAGCAG<br>CACGACTTCTTCAAGTCCGCCATGCCCGAAGGCTACGTCCAGGAGCGCACCATCTTC<br>TTCAAGGACGACGGCAACTACAAGACCCGCGCCGAGGTGAAGTTCGAGGGCGACA<br>CCCTGGTGAACCGCATCGAGCTGAAGGGCATCGACTTCAAGGAGGACGGCAACATC<br>CTGGGGCACAAGCTGGAGTACAACTACAACAGCCACAACGTCTATATCATGGCCGA<br>CAAGCAGAAGAACGGCATCAAGGTGAACTTCAAGATCCGCCACAACATCGAGGACG<br>GCAGCGTGCAGCTCGCCGACCACTACCAGCAGAACACCCCCATCGGCGACGGCCCC<br>GTGCTGCTGCCCGACAACCACTACCTGAGCACCCAGTCCAAGCTGAGCAAAGACCCC<br>AACGAGAAGCGCGATCACATGGTCCTGCTGGAGTTCGTGACCGCCGCCGGGATCAC<br>TCTCGGCATGGACGAGCTGTACAAatgattgtttattgcagcttataatggttacaaataaagcaat<br>agcatcacaaatttcacaaataaagcatttttttcactgcattctagttgtggtttgtccaaactcatcaatgtatc<br>ttatTTGCCATTCACGCCGCCAGTTGTGAAGACTGCTGGGATGGAAGAAGTCAGC<br>TGGTGGGTCTGGAGGAGCAGGCGGAGGAGAGCAGAATGGGCAGGAAGAAAAGTG<br>GTGTGAGAAAGCAGTGAAAAGTCTGGTGAAGAAGCTAAAGAAAACAGGACGATTA<br>GATGAGCTTGAGAAAGCCATCACCACTCAAAACTGTAATACTAAATGTGTTACCATA<br>CCAAGGTAAGTTTTGTTAGATCCCAGGTTTGATCAAATTATGTCAAGGAATCTGAAG<br>GAAAGTTACTGAATTTGTGTTCCTTTCAAGTTGCCTGTAAAAAGTGATGATTGAAAT<br>ATGACTGTTTTTAACCTTGTATAAATTGTTTTTGCTAGCTGACTTGTTTTATAAATTAT<br>TTTCTTGAATAGTGAGGTTTAATCAAGCTAAATAAGATACTTAGATTTATTATCTTCA<br>(SEQ ID NO: 174) | 1806 |
| pARBI-955:<br>SOCS1_1_E<br>ndogenous<br>_61 | GGGCTCCCGCAGCACAGCCTTTCTCCGGCCCTAGCCCAAATCGCCCAGACCAGGCGC<br>GGATCCCAGCCTGGCCAGCAGGCGGCGGGCGCGGGGCGGCGAGCCGGGGCCGGA<br>CGGCTGGAGCCAGAACCGGCTGCTCTCCACGCCCCCCTCTCGGTGCTGCCCGGAGG<br>CCCGGACTCCGCCTCCACCGAGCCCCCACCCGCCGGGAAGAGCTCCGCGGAGTACAG<br>AGCCCATTTTCTAGCTGTGTCCACTGAGGCTGAACGGATCCGCGCGGACTTGGTGCT<br>CCGTGCTCGCCCCCTAGGGCCGGGTCCGCCGGGAGCGCCGCCCTCCGGAGTTGTCC<br>GGCCGGCGCACACCTGCCCGGCCCCGCAGCGCCCCAGCTCACCTCTTTGTCTCTCCC<br>GCAGCGCACCCCCGGACGCTATGGCCCACCCCTCCGGCTGGCCCCTTCTGTAGGATG<br>tccggatccggagagggcagggggatctctccttacttgtggcgacgtggaggagaaccccggccccATGGT<br>GAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCA<br>CCTACGGCAAGCTGACCCTGAAGTTCATCTGCACCACCGGCAAGCTGCCCGTGCCCT<br>GGCCCACCCTCGTGACCACCCTGACCTACGGCGTGCAGTGCTTCAGCCGCTACCCCG<br>ACCACATGAAGCAGCACGACTTCTTCAAGTCCGCCATGCCCGAAGGCTACGTCCAGG<br>AGCGCACCATCTTCTTCAAGGACGACGGCAACTACAAGACCCGCGCCGAGGTGAAG<br>TTCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatGTAGCACACAACCAGGTGGCAGCCGACAATGCAGTCTCCAC<br>AGCAGCAGAGCCCCGACGGCGGCCAGAACCTTCCTCCTCTTCCTCCTCCTcgcccgcgg<br>cccccgcgcgcccgcggccgtgcccgcggtcccggccccggCCCCGGCGACACGCACTTCCGCA<br>CATTCCGTTCGCACGCCGATTACCGGCGCATCACGCGCGCCAGCGCGCTCCTGGACG<br>CCTGCGGATTCTACTGGGGGCCCCTGAGCGTGCACGGGGCGCACGAGCGGCTGCG<br>CGCCGAGCCCGTGGGCACCTTCCTGGTGCGCGACAGCCGCCAGCGGAACTGCTTTTT<br>CGCCCTTAGCGTGAAGATGGCCTCGGGACCCACGAGCATCCGCGTGCACTTTCAGG<br>CCGGCCGCTTTCACCTGGATGGCAGCCGCGAGAGCTTCGACTGCCTCTTCGAGCTGC<br>TG (SEQ ID NO: 175) | 1806 |
| pARBI-956:<br>SOCS1_2_E<br>ndogenous<br>_62 | GGATCCCAGCCTGGCCAGCAGGCGGCGGGCGCGGGGCGGCGAGCCGGGGCCGGA<br>CGGCTGGAGCCAGAACCGGCTGCTCTCCACGCCCCCCTCTCGGTGCTGCCCGGAGG<br>CCCGGACTCCGCCTCCACCGAGCCCCCACCCGCCGGGAAGAGCTCCGCGGAGTACAG<br>AGCCCATTTTCTAGCTGTGTCCACTGAGGCTGAACGGATCCGCGCGGACTTGGTGCT<br>CCGTGCTCGCCCCCTAGGGCCGGGTCCGCCGGGAGCGCCGCCCTCCGGAGTTGTCC | 1806 |

TABLE 5-continued

CONSTRUCTS USED FOR EVALUATION OF PREDICTED LOCI

| Construct name | Sequence | Length |
|---|---|---|
| | GGCCGGCGCACACCTGCCCGGCCCCGCAGCGCCCCAGCTCACCTCTTTGTCTCTCCC<br>GCAGCGCACCCCGGACGCTATGGCCCACCCCTCCGGCTGGCCCCTTCTGTAGGATG<br>GTAGCACACAACCAGGTGGCAGCCGACAATGCAGTCTCCACAGCAGCAGAGCCCCG<br>AtccggatccggagagggcaggggatctctccttacttgtggcgacgtggaggagaaccccggccccATGG<br>TGAGCAAGGGCGAGGAGCTGTTCACCGGGGTGGTGCCCATCCTGGTCGAGCTGGA<br>CGGCGACGTAAACGGCCACAAGTTCAGCGTGTCCGGCGAGGGCGAGGGCGATGCC<br>ACCTACGGCAAGCTGACCCTGAAGTTCATCTGCACCACCGGCAAGCTGCCCGTGCCC<br>TGGCCCACCCTCGTGACCACCCTGACCTACGGCGTGCAGTGCTTCAGCCGCTACCCC<br>GACCACATGAAGCAGCACGACTTCTTCAAGTCCGCCATGCCCGAAGGCTACGTCCAG<br>GAGCGCACCATCTTCTTCAAGGACGACGGCAACTACAAGACCCGCGCCGAGGTGAA<br>GTTCGAGGGCGACACCCTGGTGAACCGCATCGAGCTGAAGGGCATCGACTTCAAGG<br>AGGACGGCAACATCCTGGGGCACAAGCTGGAGTACAACTACAACAGCCACAACGTC<br>TATATCATGGCCGACAAGCAGAAGAACGGCATCAAGGTGAACTTCAAGATCCGCCA<br>CAACATCGAGGACGGCAGCGTGCAGCTCGCCGACCACTACCAGCAGAACACCCCCA<br>TCGGCGACGGCCCCGTGCTGCTGCCCGACAACCACTACCTGAGCACCCAGTCCAAGC<br>TGAGCAAAGACCCCAACGAGAAGCGCGATCACATGGTCCTGCTGGAGTTCGTGACC<br>GCCGCCGGGATCACTCTCGGCATGGACGAGCTGTACAAatgattgtttattgcagcttataat<br>ggttacaaataaagcaatagcatcacaaatttcacaaataaagcattttttcactgcattctagttgtggtttgt<br>ccaaactcatcaatgtatcttatCGGCGGCCAGAACCTTCCTCCTCTTCCTCCTCCTcgcccgcgg<br>ccccgcgcgcccgcggccgtgccccgcggtcccggccccggCCCCGGCGACACGCACTTCCGCA<br>CATTCCGTTCGCACGCCGATTACCGGCGCATCACGCGCGCCAGCGCGCTCCTGGACG<br>CCTGCGGATTCTACTGGGGGCCCCTGAGCGTGCACGGGGCGCACGAGCGGCTGCG<br>CGCCGAGCCCGTGGGCACCTTCCTGGTGCGCGACAGCCGCCAGCGGAACTGCTTTTT<br>CGCCCTTAGCGTGAAGATGGCCTCGGGACCCACGAGCATCCGCGTGCACTTTCAGG<br>CCGGCCGCTTTCACCTGGATGGCAGCCGCGAGAGCTTCGACTGCCTCTTCGAGCTGC<br>TGGAGCACTACGTGGCGGCGCCGCGCCGCATGCTGGGGGCCCCGCTGCGCCAGCG<br>CCGC (SEQ ID NO: 176) | |
| pARBI-957:<br>SOCS1_3_E<br>ndogenous<br>_63 | CGGACTCCGCCTCCACCGAGCCCCCACCCGCCGGGAAGAGCTCCGCGGAGTACAGA<br>GCCCATTTTCTAGCTGTGTCCACTGAGGCTGAACGGATCCGCGCGGACTTGGTGCTC<br>CGTGCTCGCCCCCTAGGGCCGGGTCCGCCGGGAGCGCCGCCCTCCGGAGTTGTCCG<br>GCCGGCGCACACCTGCCCGGCCCCGCAGCGCCCCAGCTCACCTCTTTGTCTCTCCCG<br>CAGCGCACCCCGGACGCTATGGCCCACCCCTCCGGCTGGCCCCTTCTGTAGGATGG<br>TAGCACACAACCAGGTGGCAGCCGACAATGCAGTCTCCACAGCAGCAGAGCCCCGA<br>CGGCGGCCAGAACCTTCCTCCTCTTCCTCCTCCTcgcccgcggccccgcgcgcccgcggccgtg<br>ccccgcggtcccggccccggCCCCGGCGACACGCACTTCCGCACAtccggatccggagagggca<br>ggggatctctccttacttgtggcgacgtggaggagaaccccggccccATGGTGAGCAAGGGCGAGG<br>AGCTGTTCACCGGGGTGGTGCCCATCCTGGTCGAGCTGGACGGCGACGTAAACGGC<br>CACAAGTTCAGCGTGTCCGGCGAGGGCGAGGGCGATGCCACCTACGGCAAGCTGA<br>CCCTGAAGTTCATCTGCACCACCGGCAAGCTGCCCGTGCCCTGGCCCACCCTCGTGA<br>CCACCCTGACCTACGGCGTGCAGTGCTTCAGCCGCTACCCCGACCACATGAAGCAGC<br>ACGACTTCTTCAAGTCCGCCATGCCCGAAGGCTACGTCCAGGAGCGCACCATCTTCT<br>TCAAGGACGACGGCAACTACAAGACCCGCGCCGAGGTGAAGTTCGAGGGCGACAC<br>CCTGGTGAACCGCATCGAGCTGAAGGGCATCGACTTCAAGGAGGACGGCAACATCC<br>TGGGGCACAAGCTGGAGTACAACTACAACAGCCACAACGTCTATATCATGGCCGAC<br>AAGCAGAAGAACGGCATCAAGGTGAACTTCAAGATCCGCCACAACATCGAGGACG<br>GCAGCGTGCAGCTCGCCGACCACTACCAGCAGAACACCCCCATCGGCGACGGCCCC<br>GTGCTGCTGCCCGACAACCACTACCTGAGCACCCAGTCCAAGCTGAGCAAAGACCCC<br>AACGAGAAGCGCGATCACATGGTCCTGCTGGAGTTCGTGACCGCCGCCGGGATCAC<br>TCTCGGCATGGACGAGCTGTACAAatgattgtttattgcagcttataatggttacaaataaagcaat<br>agcatcacaaatttcacaaataaagcattttttcactgcattctagttgtggtttgtccaaactcatcaatgtatc<br>ttatTTCCGTTCGCACGCCGATTACCGGCGCATCACGCGCGCCAGCGCGCTCCTGGAC<br>GCCTGCGGATTCTACTGGGGGCCCCTGAGCGTGCACGGGGCGCACGAGCGGCTGC<br>GCGCCGAGCCCGTGGGCACCTTCCTGGTGCGCGACAGCCGCCAGCGGAACTGCTTT<br>TTCGCCCTTAGCGTGAAGATGGCCTCGGGACCCACGAGCATCCGCGTGCACTTTCAG<br>GCCGGCCGCTTTCACCTGGATGGCAGCCGCGAGAGCTTCGACTGCCTCTTCGAGCTG<br>CTGGAGCACTACGTGGCGGCGCCGCGCCGCATGCTGGGGGCCCCGCTGCGCCAGC<br>GCCGCGTGCGGCCGCTGCAGGAGCTGTGCCGCCAGCGCATCGTGGCCACCGTGGG<br>CCGCGAGAACCTGGCTCGCATCCCCCTCAACCCCGTCCTCCGCGACTACCTGAGCTC<br>CTTC (SEQ ID NO: 177) | 1806 |
| pARBI-958:<br>SRP14_1_E<br>ndogenous<br>_64 | GGCAGACAAACAGTTAAAACAGAGGAGTGGGGTAAGTGATGACCTAACCCAGCCC<br>CGCTGCTCTAGTTTTGTTAAACACCTCATCTGCTATCACGGTCTGGCGAAACCCTGGA<br>GAAACTATTATTTCCACGACGGAAACATGTAATATCGAAGCACGTTAAATTCCACTC<br>AAAGTGGCGGCGTCTGGGATCCCTGACAAAGAGCCCTGGGCTGCTTGGGGCCCATT<br>GTTACCAGAAGCAACCTAGGCGGCTCAGTGCTGGGGACTGAGCCAGCTACAATCCC<br>TACTATTTTCCGGGCCCGAAGCCCCGAATGTGCTCAGTACAGGGTGGGGAAAGGTA<br>GAGGAAGGCGGCGGTCCGCGGCAGACAGACTCCGGTGGCTCCCAGACACCGGGAA<br>CCCAGGGAGCATCGCCCGGCTCCCCTCCCGCTGCTTACACTTCTTCAAGGTGATATAt<br>ccggatccggagagggcaggggatctctccttacttgtggcgacgtggaggagaaccccggccccATGGTG<br>AGCAAGGGCGAGGAGCTGTTCACCGGGGTGGTGCCCATCCTGGTCGAGCTGGACG<br>GCGACGTAAACGGCCACAAGTTCAGCGTGTCCGGCGAGGGCGAGGGCGATGCCAC<br>CTACGGCAAGCTGACCCTGAAGTTCATCTGCACCACCGGCAAGCTGCCCGTGCCCTG<br>GCCCACCCTCGTGACCACCCTGACCTACGGCGTGCAGTGCTTCAGCCGCTACCCCGA<br>CCACATGAAGCAGCACGACTTCTTCAAGTCCGCCATGCCCGAAGGCTACGTCCAGGA | 1806 |

TABLE 5-continued

CONSTRUCTS USED FOR EVALUATION OF PREDICTED LOCI

| Construct name | Sequence | Length |
|---|---|---|
| | GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTC<br>TATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttcactgcattctagttgtggtttgtcc<br>aaaactcatcaatgtatcttatGACGCTGCCCGACGTCCGGCACTTCTGGAAAAGTCTGGTCA<br>GCTCCGTCAGGAACTGGAAAACAACAGGCCCAGCCCCGTTAGCCAGCCCCAAATCCT<br>CGTCCTGCCGCGTCAAGGCCCTGGTCCTCCTGCAGGAGGCACAGGTCTCGAGTAAC<br>GCCTGAGCCGCCCCCTTCCCTCGGCCGGCCAGGCCTAGCCATACCTGCTCGCTCTCC<br>AACAACACCATCGCGGCGACGCTGGCTCGACTCCCTCCGCTTAAGCCCCTAGCAGTG<br>AGAGCCGGAAGTTCGGCCTAGGCTGGGCGGGACTTCCGCTACTAGACTTCCATTGT<br>CTTCCACCAATCTCTTCTTCCACCAATCCCGGCCTGCGCCCTCCCCCTCCCCGCCC<br>GCCTAGCGCCCGCGCCCTGGGACGTCCGGGGGCCTGTGACCCGGAGGCGCTGGGG<br>CTGTCCTGGGTC (SEQ ID NO: 178) | |
| pARBI-959: SRP14_2_Endogenous_65_66 | GTCTGTCTGCCGCGGACCGCCGCCTTCCTCTACCTTTCCCCACCCTGTACTGAGCACA<br>TTCGGGGCTTCGGGCCCGGAAAATAGTAGGGATTGTAGCTGGCTCAGTCCCCAGCA<br>CTGAGCCGCCTAGGTTGCTTCTGGTAACAATGGGCCCAAGCAGCCCAGGGCTCTTT<br>GTCAGGGATCCCAGACGCCGCCACTTTGAGTGGAATTTAACGTGCTTCGATATTACA<br>TGTTTCCGTCGTGGAAATAATAGTTTCTCCAGGGTTTCGCCAGACCGTGATAGCAGA<br>TGAGGTGTTTAACAAAACTAGAGCAGCGGGGCTGGGTTAGGTCATCACTTACCCCA<br>CTCCTCTGTTTTAACTGTTTGTCTGCCGCTCAGCCACGTACGCGGCCGTGTTCACCAG<br>GATGCATTTTTTCCTTCAGATGACGGTCGAACCAAACCCATTCCAAAGAAGtccggatc<br>cggagagggcaggggatctctccttacttgtggcgacgtggaggagaaccccggccccATGGTGAGCAA<br>GGGCGAGGAGCTGTTCACCGGGGTGGTGCCCATCCTGGTCGAGCTGGACGGCGAC<br>GTAAACGGCCACAAGTTCAGCGTGTCCGGCGAGGGCGAGGGCGATGCCACCTACG<br>GCAAGCTGACCCTGAAGTTCATCTGCACCACCGGCAAGCTGCCCGTGCCCTGGCCCA<br>CCCTCGTGACCACCCTGACCTACGGCGTGCAGTGCTTCAGCCGCTACCCCGACCACA<br>TGAAGCAGCACGACTTCTTCAAGTCCGCCATGCCCGAAGGCTACGTCCAGGAGCGC<br>ACCATCTTCTTCAAGGACGACGGCAACTACAAGACCCGCGCCGAGGTGAAGTTCGA<br>GGGCGACACCCTGGTGAACCGCATCGAGCTGAAGGGCATCGACTTCAAGGAGGAC<br>GGCAACATCCTGGGGCACAAGCTGGAGTACAACTACAACAGCCACAACGTCTATAT<br>CATGGCCGACAAGCAGAAGAACGGCATCAAGGTGAACTTCAAGATCCGCCACAACA<br>TCGAGGACGGCAGCGTGCAGCTCGCCGACCACTACCAGCAGAACACCCCCATCGGC<br>GACGGCCCCGTGCTGCTGCCCGACAACCACTACCTGAGCACCCAGTCCAAGCTGAG<br>CAAAGACCCCAACGAGAAGCGCGATCACATGGTCCTGCTGGAGTTCGTGACCGCCG<br>CCGGGATCACTCTCGGCATGGACGAGCTGTACAAatgattgtttattgcagcttataatggttac<br>aaataaagcaatagcatcacaaatttcacaaataaagcattttttcactgcattctagttgtggtttgtccaaac<br>tcatcaatgtatcttatGGTACTGTGGAGGGCTTTGAGCCCGCAGACAACAAGTGTCTGTT<br>AAGAGCTACCGATGGGAAGAAGAAGATCAGCACTGTGGTGAGCTTAATTTCTAAGG<br>CTGTCTTTTGAAATGTAAAGACTTGAACTTAACAGAGGATGGGGCGTTTCTGAACCA<br>GGCTTTTATTTGTTTTTCCCTTTTGCCCTGTGTGGCTATTTTTGAGACCAGGACCTTCC<br>TATACTTTAGTAGTGGAAACCTCAAGAATAAAATAAGAAGGTAGAGGTCAGACAGT<br>CGTTAGTTCTGCTAAAGCTCTTGTGGAAATGAAAGTAGCATATTGGTCCTTATTCGTA<br>GTACTGTAAGGAGCAGCTGGCATAAATATTTGATTCCTTAGCCCCTTACTGTGCTGG<br>GCCTTCAATAAGCAGTTTCTTGGTACCAGGTGATGCTATTATTTCCTTATCTTTGTGG<br>TTCAC (SEQ ID NO: 179) | 1806 |
| pARBI-960: SRSF9_1_Endogenous_67 | CCCACGTCAGTGAGTGCTCACAAGTCTGTGAGGTAGGCGGCGCCACAGAGAGAAAC<br>TGAGGCGCGGGAGCCCAAGCCACTTGTCCAGCGCCTCAGCCGAGCGCGAACCGCGC<br>TCGGGGATGGCATCCACACGGCCCGGCCCCAGGCTCTCCCTGTCAGCGCCCGAAGG<br>CCCTTCGCACCTCCAGGGGGCGCCGGCCTGCGCGCACGCGCAATGGTCGCAGCCGC<br>GTTCTCTTTAAGAGGACTCCTTTTGCCTCCGCCGACCCCTTCGCTTCCGCTCCGCGTTC<br>CCACAATGCAGTGCGGCTGAGCGCCTCGGAGCCCGCGGGGACGCTGCGGGGGGAC<br>CCGTGCTGAggcggcggcggcgacgtgggctgcggcgggcccgcggcgtcgggcggtgcggatgtcggg<br>ctgggcggacgagcgcggcggcAGGGCGACGGGCGCATCTACtccggatccggagagggcaggg<br>gatctctccttacttgtggcgacgtggaggagaaccccggccccATGGTGAGCAAGGGCGAGGAGC<br>TGTTCACCGGGGTGGTGCCCATCCTGGTCGAGCTGGACGGCGACGTAAACGGCCAC<br>AAGTTCAGCGTGTCCGGCGAGGGCGAGGGCGATGCCACCTACGGCAAGCTGACCCT<br>GAAGTTCATCTGCACCACCGGCAAGCTGCCCGTGCCCTGGCCCACCCTCGTGACCAC<br>CCTGACCTACGGCGTGCAGTGCTTCAGCCGCTACCCCGACCACATGAAGCAGCACG<br>ACTTCTTCAAGTCCGCCATGCCCGAAGGCTACGTCCAGGAGCGCACCATCTTCTTCA<br>AGGACGACGGCAACTACAAGACCCGCGCCGAGGTGAAGTTCGAGGGCGACACCCT<br>GGTGAACCGCATCGAGCTGAAGGGCATCGACTTCAAGGAGGACGGCAACATCCTG<br>GGGCACAAGCTGGAGTACAACTACAACAGCCACAACGTCTATATCATGGCCGACAA<br>GCAGAAGAACGGCATCAAGGTGAACTTCAAGATCCGCCACAACATCGAGGACGGCA<br>GCGTGCAGCTCGCCGACCACTACCAGCAGAACACCCCCATCGGCGACGGCCCCGTG<br>CTGCTGCCCGACAACCACTACCTGAGCACCCAGTCCAAGCTGAGCAAAGACCCCAAC<br>GAGAAGCGCGATCACATGGTCCTGCTGGAGTTCGTGACCGCCGCCGGGATCACTCT<br>CGGCATGGACGAGCTGTACAAatgattgtttattgcagcttataatggttacaaataaagcaatagca<br>tcacaaatttcacaaataaagcattttttcactgcattctagttgtggtttgtccaaactcatcaatgtatcttat | 1806 |

TABLE 5-continued

CONSTRUCTS USED FOR EVALUATION OF PREDICTED LOCI

| Construct name | Sequence | Length |
|---|---|---|
| | GTGGGGAACCTTCCGACCGACGTGCGCGAGAAGGACTTGGAGGACCTGTTCTACAA<br>GTACGGCCGCATCCGCGAGATCGAGCTCAAGAACCGGCACGGCCTCGTGCCCTTCG<br>CCTTCGTGCGCTTCGAGGACCCCCGGTGAGGccccgcgccctgccctctcctcctcggtgcct<br>gaggccccgccttccctgctgtccctcccccagggctccctcccccggcctccctccccccgcctccgcgc<br>agaccctcaCGGCGCCCCCTCACGGGTGGAGGATGAGGCAGCCTCTCCTCGCAGGCC<br>CGGGCCGTCCTTCGCGCCGTCGTCACTTCCTTTATTTTATTATTCCAATATTTTACTT<br>AGAAACCCAAAAGCTGAGCCTTTGGAGGGCCCAAGCCCGCCTGCACCGGCCTCGGG<br>GGGTCCAAATGAGCCTTGTCCGCC (SEQ ID NO: 180) | |
| pARBI-961:<br>SRSF9_2_En<br>dogenous_<br>68 | TGTGGTGTGCTTTTCGAGAAAATGCTCACGAAGATTAGAAAAACACTGATGGTTTAT<br>TGGCAAAATCAATAATCTGTCAGCAGTTGATTCttttttttCTCTGAATTAGCCCTCTTAT<br>GAGTAATCTGTTTGCTCATTCATTATAATTTCATACCTCTAAAACTGCGTGTGACAGC<br>TGTAAAGGTTAATTCCAGTATCATGAAACGTCTCCAAACCAAAGCAGAAGTGCTTCA<br>GGATCCTGATTTGTGTGTTTTTTTCTTCACTCTAGGTTTCCCTTTTATGCTTACTACTCA<br>TGCCCCTCACTTGGAAAGTCACTTGGCCTCCTGAACAGCACTAACTCCAAACGtttttttt<br>gttgttgttgttttttttAGAGATGCAGAGGATGCTATTTATGGAAGAAATGGTTATGATTAT<br>GGCCAGTGTCGGCTTCGTGTGGAGTTCCCCAGGTccggatccggagagggcaggggatctctc<br>cttacttgtggcgacgtggaggagaaccccggccccATGGTGAGCAAGGGCGAGGAGCTGTTCA<br>CCGGGGTGGTGCCCATCCTGGTCGAGCTGGACGGCGACGTAAACGGCCACAAGTTC<br>AGCGTGTCCGGCGAGGGCGAGGGCGATGCCACCTACGGCAAGCTGACCCTGAAGT<br>TCATCTGCACCACCGGCAAGCTGCCCGTGCCCTGGCCCACCCTCGTGACCACCCTGA<br>CCTACGGCGTGCAGTGCTTCAGCCGCTACCCCGACCACATGAAGCAGCACGACTTCT<br>TCAAGTCCGCCATGCCCGAAGGCTACGTCCAGGAGCGCACCATCTTCTTCAAGGACG<br>ACGGCAACTACAAGACCCGCGCCGAGGTGAAGTTCGAGGGCGACACCCTGGTGAA<br>CCGCATCGAGCTGAAGGGCATCGACTTCAAGGAGGACGGCAACATCCTGGGGCAC<br>AAGCTGGAGTACAACTACAACAGCCACAACGTCTATATCATGGCCGACAAGCAGAA<br>GAACGGCATCAAGGTGAACTTCAAGATCCGCCACAACATCGAGGACGGCAGCGTGC<br>AGCTCGCCGACCACTACCAGCAGAACACCCCCATCGGCGACGGCCCCGTGCTGCTG<br>CCCGACAACCACTACCTGAGCACCCAGTCCAAGCTGAGCAAAGACCCCAACGAGAA<br>GCGCGATCACATGGTCCTGCTGGAGTTCGTGACCGCCGCCGGGATCACTCTCGGCAT<br>GGACGAGCTGTACAAatgattgtttattgcagcttataatggttacaaataaagcaatagcatcacaaat<br>ttcacaaataaagcattttttttcactgcattctagttgtggtttgtccaaactcatcaatgtatcttatACTTATG<br>GAGGTCGGGGTGGGTGGCCCCGTGGTGGGAGGAATGGGCCTCCTACAGAAGATC<br>TGATTTCCGAGTTCTTGTTTCAGGTATGTTCCTTTCAAACAGaatgagatgatacatgtaaaa<br>tacttaacacagagtctgtcttccaagaaatgatagctgttattcttCAGTGCATGGGACACGGGGGC<br>TTTCTTTTCAATAGCCTGTGTGAAGCCTTGCCCTGGATTGCCAATGAGGAAAGTATCC<br>TGCAAATGAAATTGCGCTGGGAGTGCAGCCTTGGAAGAACATAACCATATTTCTTGT<br>AAAGGAGTTTTCTAGTGGTGAGAAGGAAAGATGATGGGAAAACTTGAGCTACAATT<br>CTAAAGATGCTTCTTTTGGAATATACTTGGCATCAGACATGGTAGAAAGGCATTCAA<br>GGAGCCAGATTTGAACAACTTACCCAGCC (SEQ ID NO: 181) | 1806 |
| pARBI-962:<br>SRSF9_3_En<br>dogenous_<br>69 | GATGGCATCCACACGGCCCGGCCCCAGGCTCTCCCTGTCAGCGCCCGAAGGCCCTTC<br>GCACCTCCAGGGGGCGCCGGCCTGCGCGCACGCGCAATGGTCGCAGCCGCGTTCTC<br>TTTAAGAGGACTCCTTTTGCCTCCGCCGACCCCTTCGCTTCCGCTCCGCGTTCCCACA<br>ATGCAGTGCGGCTGAGCGCCTCGGAGCCCGCGGGGACGGCTGGCGGGGACCCGTG<br>CTGAggcggcggcggcgacgtgggctgcgcggggcccgcggcgtcggcgtgcggatgtcgggctgggcg<br>gacgagcgcggcggcgAGGGCGACGGGCGCATCTACGTGGGGAACCTTCCGACCGACGT<br>GCGCGAGAAGGACTTGGAGGACCTGTTCTACAAGTACGGCCGCATCCGCGAGATCG<br>AGCTCAAGAACCGGCACGGCCTCGTGCCCTTCGCCTTCtccggatccggagagggcaggggga<br>tctctccttacttgtggcgacgtggaggagaaccccggccccATGGTGAGCAAGGGCGAGGAGCT<br>GTTCACCGGGGTGGTGCCCATCCTGGTCGAGCTGGACGGCGACGTAAACGGCCACA<br>AGTTCAGCGTGTCCGGCGAGGGCGAGGGCGATGCCACCTACGGCAAGCTGACCCT<br>GAAGTTCATCTGCACCACCGGCAAGCTGCCCGTGCCCTGGCCCACCCTCGTGACCAC<br>CCTGACCTACGGCGTGCAGTGCTTCAGCCGCTACCCCGACCACATGAAGCAGCACG<br>ACTTCTTCAAGTCCGCCATGCCCGAAGGCTACGTCCAGGAGCGCACCATCTTCTTCA<br>AGGACGACGGCAACTACAAGACCCGCGCCGAGGTGAAGTTCGAGGGCGACACCCT<br>GGTGAACCGCATCGAGCTGAAGGGCATCGACTTCAAGGAGGACGGCAACATCCTG<br>GGGCACAAGCTGGAGTACAACTACAACAGCCACAACGTCTATATCATGGCCGACAA<br>GCAGAAGAACGGCATCAAGGTGAACTTCAAGATCCGCCACAACATCGAGGACGGCA<br>GCGTGCAGCTCGCCGACCACTACCAGCAGAACACCCCCATCGGCGACGGCCCCGTG<br>CTGCTGCCCGACAACCACTACCTGAGCACCCAGTCCAAGCTGAGCAAAGACCCCAAC<br>GAGAAGCGCGATCACATGGTCCTGCTGGAGTTCGTGACCGCCGCCGGGATCACTCT<br>CGGCATGGACGAGCTGTACAAatgattgtttattgcagcttataatggttacaaataaagcaatagca<br>tcacaaatttcacaaataaagcattttttttcactgcattctagttgtggtttgtccaaactcatcaatgtatcttat<br>GTGCGCTTCGAGGACCCCCGGTGAGGccccgcgccctgccctctcctcctcggtgcctgaggcc<br>cccgccttccctgctgtccctcccccagggctccctcccccggcctccctccccccgcctccgcgcagaccc<br>ctcaCGGCGCCCCCTCACGGGTGGAGGATGAGGCAGCCTCTCCTCGCAGGCCCGGGCC<br>GTCCTTCGCGCCGTCGTCACTTCCTTTATTTTATTATTCCAATATTTTACTTGGAGAAAC<br>CCAAAAGCTGAGCCTTTGGAGGGCCCAAGCCCGCCTGCACCGGCCTCGGGGGGTCC<br>AAATGAGCCTTGTCCGCCTCCTGCCTGGGGCAGCACCGTAGGGGGAAGCGGCCGCG<br>GGGCAGCGCGGGGTCGCCGTTCGCCCTTCCCGCTCGCCTCTCCCCCGGCCCGTGCT<br>CGCCGTGGCTGGAGAGCAAGCT (SEQ ID NO: 182) | 1806 |
| pARBI-963:<br>SUI31_1_En<br>dogenous | GTAACTGACTAGCCTTAGTAGACTGTGGTTTCCAGGTTTATTCAGAAGTAGCAAGAT<br>CCCTCCAtttttttttCTACCAAAGAAATCGTATGTGGGATCCCAAACCACAAAATAACCG | 1806 |

TABLE 5-continued

CONSTRUCTS USED FOR EVALUATION OF PREDICTED LOCI

| Construct name | Sequence | Length |
| --- | --- | --- |
| dogenous_ 70 | TTCCTGTGGTTAATACTACTATAATGCCTGAAGTGTCTTTTGGGATCCTGAGAACAGA GTTTGAAAACATTACTAGACAGAAGGATTGGTTAGATTCATAGTTTTGTTGTTGAGT GAAACTTGCTTATGTATATATTTATGATATTTTGGATGTAGTCTTTTGATTGTTTAAAT CTTAAAAAGTAATGGGATCTTTTGACACTGGGGTATGTTTTATTTTTATGTGTGCAAA TTTTAACCATATTCTTTTCTAGTTAAAGAGGAAAAAGCAAGTTGCTCCAGAAAAACCT GTAAAGAAACAAAAGACAGGTGAGACTTCGAGAGCCCTGTCAtccggatccggagagggc aggggatctctccttacttgtggcgacgtggaggagaaccccggccccATGGTGAGCAAGGGCGAGG AGCTGTTCACCGGGGTGGTGCCCATCCTGGTCGAGCTGGACGGCGACGTAAACGGC CACAAGTTCAGCGTGTCCGGCGAGGGCGAGGGCGATGCCACCTACGGCAAGCTGA CCCTGAAGTTCATCTGCACCACCGGCAAGCTGCCCGTGCCCTGGCCCACCCTCGTGA CCACCCTGACCTACGGCGTGCAGTGCTTCAGCCGCTACCCCGACCACATGAAGCAGC ACGACTTCTTCAAGTCCGCCATGCCCGAAGGCTACGTCCAGGAGCGCACCATCTTCT TCAAGGACGACGGCAACTACAAGACCCGCGCCGAGGTGAAGTTCGAGGGCGACAC CCTGGTGAACCGCATCGAGCTGAAGGGCATCGACTTCAAGGAGGACGGCAACATCC TGGGGCACAAGCTGGAGTACAACTACAACAGCCACAACGTCTATATCATGGCCGAC AAGCAGAAGAACGGCATCAAGGTGAACTTCAAGATCCGCCACAACATCGAGGACG GCAGCGTGCAGCTCGCCGACCACTACCAGCAGAACACCCCCATCGGCGACGGCCCC GTGCTGCTGCCCGACAACCACTACCTGAGCACCCAGTCCAAGCTGAGCAAAGACCCC AACGAGAAGCGCGATCACATGGTCCTGCTGGAGTTCGTGACCGCCGCCGGGATCAC TCTCGGCATGGACGAGCTGTACAAatgattgtttattgcagcttataatggttacaaataaagcaat agcatcacaaatttcacaaataaagcattttttcactgcattctagttgtggtttgtccaaactcatcaatgtatc ttatTCTTCTAAACAGAGCAGCAGCAGCAGAGATGATAACATGTTTCAGGTAAAGTTG GCTAttttttttttttttttttgacatggagtcatgctctgtcacccaggctggagtgcagtggcgccatctcgg ctcactgcaacctcctgagttcaagcagttctctgcctcccgagtagctaggattacaggcat ccgccaccagacctggctaattttttgtattttttagtagagatgggtttcaccatcttggccaggctggtcttgcc AAAGTTGGCTGTTTCTTTAGATTCAGAGGAATTATTATCTGGCTTGATCTGAAGAAT GTTAAAAGTACTATGATCTGATAATTGCCTAATATG (SEQ ID NO: 183) | |
| pARBI-964: SUT31_2_En dogenous_ 71 | ATAAATAAACATATCCTGGAAATGGAATAAGTTGGTTATATTCTTTTTAATTAGTATA TCTGCTTCGTAAAATAAGTAACTGACTAGCCTTAGTAGACTGTGGTTTCCAGGTTTAT TCAGAAGTAGCAAGATCCCTCCATTTTTTTTTCTACCAAAGAAATCGTATGTGGGATC CCAAACCACAAAATAACCGTTCCTGTGGTTAATACTACTATAATGCCTGAAGTGTCTT TTGGGATCCTGAGAACAGAGTTTGAAAACATTACTAGACAGAAGGATTGGTTAGAT TCATAGTTTTGTTGTTGAGTGAAACTTGCTTATGTATATATTTATGATATTTTGGATGT AGTCTTTTGATTGTTTAAATCTTAAAAAGTAATGGGATCTTTTGACACTGGGGTATGT TTTATTTTTATGTGTGCAAATTTTAACCATATTCTTTTCTAGTTAAtccggatccggagagggc aggggatctctccttacttgtggcgacgtggaggagaaccccggccccATGGTGAGCAAGGGCGAGG AGCTGTTCACCGGGGTGGTGCCCATCCTGGTCGAGCTGGACGGCGACGTAAACGGC CACAAGTTCAGCGTGTCCGGCGAGGGCGAGGGCGATGCCACCTACGGCAAGCTGA CCCTGAAGTTCATCTGCACCACCGGCAAGCTGCCCGTGCCCTGGCCCACCCTCGTGA CCACCCTGACCTACGGCGTGCAGTGCTTCAGCCGCTACCCCGACCACATGAAGCAGC ACGACTTCTTCAAGTCCGCCATGCCCGAAGGCTACGTCCAGGAGCGCACCATCTTCT TCAAGGACGACGGCAACTACAAGACCCGCGCCGAGGTGAAGTTCGAGGGCGACAC CCTGGTGAACCGCATCGAGCTGAAGGGCATCGACTTCAAGGAGGACGGCAACATCC TGGGGCACAAGCTGGAGTACAACTACAACAGCCACAACGTCTATATCATGGCCGAC AAGCAGAAGAACGGCATCAAGGTGAACTTCAAGATCCGCCACAACATCGAGGACG GCAGCGTGCAGCTCGCCGACCACTACCAGCAGAACACCCCCATCGGCGACGGCCCC GTGCTGCTGCCCGACAACCACTACCTGAGCACCCAGTCCAAGCTGAGCAAAGACCCC AACGAGAAGCGCGATCACATGGTCCTGCTGGAGTTCGTGACCGCCGCCGGGATCAC TCTCGGCATGGACGAGCTGTACAAatgattgtttattgcagcttataatggttacaaataaagcaat agcatcacaaatttcacaaataaagcattttttcactgcattctagttgtggtttgtccaaactcatcaatgtatc ttatAAGAGGAAAAAGCAAGTTGCTCCAGAAAAACCTGTAAAGAAACAAAAGACAGG TGAGACTTCGAGAGCCCTGTCATCTTCTAAACAGAGCAGCAGCAGCAGAGATGATA ACATGTTTCAGGTAAAGTTGGCTATTTTTTTTTTTTTTTTTGACATGGAGTCATGC TCTGTCACCCAGGCTGGAGTGCAGTGGCGCCATCTCGGCTCACTGCAACCTCAGCCT CCTGAGTTCAAGCAGTTCTCTGCCTCAGCCTCCCGAGTAGCTAGGATTACAGGCATC CGCCACCAGACCTGGCTAATTTTTTGTATTTTTAGTAGAGATGGGGTTTCACCATCTTG GCCAGGCTGGTCTTGAACTCCTGACCTTGTGATCCAACTGCCTCAGCCTCCAAAAGT GCTGGGTTTACAGGTGTGAGCCACCATGCCTTGCCAAAGTTGGCTGTTTCTTT (SEQ ID NO: 184) | 1806 |
| pARBI-965: SU131_3_En dogenous_ 72 | AATTAGTATATCTGCTTCGTAAAATAAGTAACTGACTAGCCTTAGTAGACTGTGGTTT CCAGGTTTATTCAGAAGTAGCAAGATCCCTCCATTTTTTTTTCTACCAAAGAAATCGT ATGTGGGATCCCAAACCACAAAATAACCGTTCCTGTGGTTAATACTACTATAATGCCT GAAGTGTCTTTTGGGATCCTGAGAACAGAGTTTGAAAACATTACTAGACAGAAGGA TTGGTTAGATTCATAGTTTTGTTGTTGAGTGAAACTTGCTTATGTATATATTTATGAT ATTTTGGATGTAGTCTTTTGATTGTTTAAATCTTAAAAAGTAATGGGATCTTTTGACA CTGGGGTATGTTTTATTTTTATGTGTGCAAATTTTAACCATATTCTTTTCTAGTTAAAG AGGAAAAAGCAAGTTGCTCCAGAAAAACCTGTAAAGAAACAAAAGACAGGTGAGA CTTCGAGAGCCCTGTCAtccggatccggagagggcaggggatctctccttacttgtggcgacgtggaggagaaccccggccccATGGTGAGCAAGGGCG AGGAGCTGTTCACCGGGGTGGTGCCCATCCTGGTCGAGCTGGACGGCGACGTAAAC GGCCACAAGTTCAGCGTGTCCGGCGAGGGCGAGGGCGATGCCACCTACGGCAAGC TGACCCTGAAGTTCATCTGCACCACCGGCAAGCTGCCCGTGCCCTGGCCCACCCTCG TGACCACCCTGACCTACGGCGTGCAGTGCTTCAGCCGCTACCCCGACCACATGAAGC | 1806 |

TABLE 5-continued

CONSTRUCTS USED FOR EVALUATION OF PREDICTED LOCI

| Construct name | Sequence | Length |
|---|---|---|
| | AGCACGACTTCTTCAAGTCCGCCATGCCCGAAGGCTACGTCCAGGAGCGCACCATCT<br>TCTTCAAGGACGACGGCAACTACAAGACCCGCGCCGAGGTGAAGTTCGAGGGCGA<br>CACCCTGGTGAACCGCATCGAGCTGAAGGGCATCGACTTCAAGGAGGACGGCAACA<br>TCCTGGGGCACAAGCTGGAGTACAACTACAACAGCCACAACGTCTATATCATGGCCG<br>ACAAGCAGAAGAACGGCATCAAGGTGAACTTCAAGATCCGCCACAACATCGAGGAC<br>GGCAGCGTGCAGCTCGCCGACCACTACCAGCAGAACACCCCCATCGGCGACGGCCC<br>CGTGCTGCTGCCCGACAACCACTACCTGAGCACCCAGTCCAAGCTGAGCAAAGACCC<br>CAACGAGAAGCGCGATCACATGGTCCTGCTGGAGTTCGTGACCGCCGCCGGGATCA<br>CTCTCGGCATGGACGAGCTGTACAAatgattgtttattgcagcttataatggttacaaataaagcaa<br>tagcatcacaaatttcacaaataaagcattttttcactgcattctagttgtggtttgtccaaactcatcaatgtat<br>cttatACAGGTGAGACTTCGAGAGCCCTGTCATCTTCTAAACAGAGCAGCAGCAGCAG<br>AGATGATAACATGTTTCAGGTAAAGTTGGCTATTTTTTTTTTTTTTTTTGACATGG<br>AGTCATGCTCTGTCACCCAGGCTGGAGTGCAGTGGCGCCATCTCGGCTCACTGCAAC<br>CTCAGCCTCCTGAGTTCAAGCAGTTCTCTGCCTCAGCCTCCCGAGTAGCTAGGATTAC<br>AGGCATCCGCCACCAGACCTGGCTAATTTTTGTATTTTTAGTAGAGATGGGGTTTCA<br>CCATCTTGGCCAGGCTGGTCTTGAACTCCTGACCTTGTGATCCAACTGCCTCAGCCTC<br>CAAAAGTGCTGGGTTTACAGGTGTGAGCCACCATGCCTTGCCAAAGTTGGCTGTTTC<br>TTTAGATTCAGAGGAATTATTATCTGGCTTGATCTGAAGAATGTTAAAAGT (SEQ ID<br>NO: 185) | |
| pARBI-966:<br>TET2_1_En<br>dogenous_<br>73 | CACATTTTAATTTTTGTTTCCATGCTCTTTAGAATTCAACTAGAGGGCAGCCTTGTGG<br>ATGGCCCCGAAGCAAGCCTGATGGAACAGGATAGAACCAACCATGTTGAGGGCAAC<br>AGACTAAGTCCATTCCTGATACCATCACCTCCCATTTGCCAGACAGAACCTCTGGCTA<br>CAAAGCTCCAGAATGGAAGCCCACTGCCTGAGAGAGCTCATCCAGAAGTAAATGGA<br>GACACCAAGTGGCACTCTTTCAAAAGTTATTATGGAATACCCTGTATGAAGGGAAGC<br>CAGAATAGTCGTGTGAGTCCTGACTTTACACAAGAAAGTAGAGGGTATTCCAAGTG<br>TTTGCAAAATGGAGGAATAAAACGCACAGTTAGTGAACCTTCTCTCTCTGGGCTCCT<br>TCAGATCAAGAAATTGAAACAAGACCAAAAGGCTAATGGAGAAAGACGTAACtccgg<br>atccggagagggcaggggatctctccttacttgtggcgacgtggaggagaaccccggccccATGGTGAGC<br>AAGGGCGAGGAGCTGTTCACCGGGGTGGTGCCCATCCTGGTCGAGCTGGACGGCG<br>ACGTAAACGGCCACAAGTTCAGCGTGTCCGGCGAGGGCGAGGGCGATGCCACCTA<br>CGGCAAGCTGACCCTGAAGTTCATCTGCACCACCGGCAAGCTGCCCGTGCCCTGGCC<br>CACCCTCGTGACCACCCTGACCTACGGCGTGCAGTGCTTCAGCCGCTACCCCGACCA<br>CATGAAGCAGCACGACTTCTTCAAGTCCGCCATGCCCGAAGGCTACGTCCAGGAGC<br>GCACCATCTTCTTCAAGGACGACGGCAACTACAAGACCCGCGCCGAGGTGAAGTTC<br>GAGGGCGACACCCTGGTGAACCGCATCGAGCTGAAGGGCATCGACTTCAAGGAGG<br>ACGGCAACATCCTGGGGCACAAGCTGGAGTACAACTACAACAGCCACAACGTCTAT<br>ATCATGGCCGACAAGCAGAAGAACGGCATCAAGGTGAACTTCAAGATCCGCCACAA<br>CATCGAGGACGGCAGCGTGCAGCTCGCCGACCACTACCAGCAGAACACCCCCATCG<br>GCGACGGCCCCGTGCTGCTGCCCGACAACCACTACCTGAGCACCCAGTCCAAGCTG<br>AGCAAAGACCCCAACGAGAAGCGCGATCACATGGTCCTGCTGGAGTTCGTGACCGC<br>CGCCGGGATCACTCTCGGCATGGACGAGCTGTACAAatgattgtttattgcagcttataatggt<br>tacaaataaagcaatagcatcacaaatttcacaaataaagcattttttcactgcattctagttgtggtttgtcca<br>aactcatcaatgtatcttatTTCGGGGTAAGCCAAGAAAGAAATCCAGGTGAAAGCAGTCA<br>ACCAAATGTCTCCGATTTGAGTGATAAGAAAGAATCTGTGAGTTCTGTAGCCCAAGA<br>AAATGCAGTTAAAGATTTCACCAGTTTTTCAACACATAACTGCAGTGGGCCTGAAAA<br>TCCAGAGCTTCAGATTCTGAATGAGCAGGAGGGGAAAAGTGCTAATTACCATGACA<br>AGAACATTGTATTACTTAAAAACAAGGCAGTGCTAATGCCTAATGGTGCTACAGTTT<br>CTGCCTCTTCCGTGGAACACACACATGGTGAACTCCTGGAAAAAACACTGTCTCAAT<br>ATTATCCAGATTGTGTTTCCATTGCGGTGCAGAAAACCACATCTCACATAAATGCCAT<br>TAACAGTCAGGCTACTAATGAGTTGTCCTGTGAGATCACTCACCCATCGCATACCTCA<br>GGGCAGATC (SEQ ID NO: 186) | 1806 |
| pARBI-967:<br>TET2_2_En<br>dogenous_<br>74 | AATGGAGAAAGACGTAACTTCGGGGTAAGCCAAGAAAGAAATCCAGGTGAAAGCAT<br>GTCAACCAAATGTCTCCGATTTGAGTGATAAGAAAGAATCTGTGAGTTCTGTAGCCC<br>AAGAAAATGCAGTTAAAGATTTCACCAGTTTTTCAACACATAACTGCAGTGGGCCTG<br>AAAATCCAGAGCTTCAGATTCTGAATGAGCAGGAGGGGAAAAGTGCTAATTACCAT<br>GACAAGAACATTGTATTACTTAAAAACAAGGCAGTGCTAATGCCTAATGGTGCTACA<br>GTTTCTGCCTCTTCCGTGGAACACACACATGGTGAACTCCTGGAAAAAACACTGTCT<br>CAATATTATCCAGATTGTGTTTCCATTGCGGTGCAGAAAACCACATCTCACATAAATG<br>CCATTAACAGTCAGGCTACTAATGAGTTGTCCTGTGAGATCACTCACCCATCGtccgga<br>tccggagagggcaggggatctctccttacttgtggcgacgtggaggagaaccccggccccATGGTGAGCA<br>AGGGCGAGGAGCTGTTCACCGGGGTGGTGCCCATCCTGGTCGAGCTGGACGGCGA<br>CGTAAACGGCCACAAGTTCAGCGTGTCCGGCGAGGGCGAGGGCGATGCCACCTAC<br>GGCAAGCTGACCCTGAAGTTCATCTGCACCACCGGCAAGCTGCCCGTGCCCTGGCCC<br>ACCCTCGTGACCACCCTGACCTACGGCGTGCAGTGCTTCAGCCGCTACCCCGACCAC<br>ATGAAGCAGCACGACTTCTTCAAGTCCGCCATGCCCGAAGGCTACGTCCAGGAGCG<br>CACCATCTTCTTCAAGGACGACGGCAACTACAAGACCCGCGCCGAGGTGAAGTTCG<br>AGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATA<br>TCATGGCCGACAAGCAGAAGAACGGCATCAAGGTGAACTTCAAGATCCGCCACAAC<br>ATCGAGGACGGCAGCGTGCAGCTCGCCGACCACTACCAGCAGAACACCCCCATCGG<br>CGACGGCCCCGTGCTGCTGCCCGACAACCACTACCTGAGCACCCAGTCCAAGCTGA<br>GCAAAGACCCCAACGAGAAGCGCGATCACATGGTCCTGCTGGAGTTCGTGACCGCC<br>GCCGGGATCACTCTCGGCATGGACGAGCTGTACAAatgattgtttattgcagcttataatggtt | 806 |

TABLE 5-continued

CONSTRUCTS USED FOR EVALUATION OF PREDICTED LOCI

| Construct name | Sequence | Length |
|---|---|---|
| | acaaataaagcaatagcatcacaaatttcacaaataaagcatttttttcactgcattctagttgtggtttgtccaa<br>actcatcaatgtatcttatCATACCTCAGGGCAGATCAATTCCGCACAGACCTCTAACTCTG<br>AGCTGCCTCCAAAGCCAGCTGCAGTGGTGAGTGAGGCCTGTGATGCTGATGATGCT<br>GATAATGCCAGTAAACTAGCTGCAATGCTAAATACCTGTTCCTTTCAGAAACCAGAA<br>CAACTACAACAACAAAAATCAGTTTTTGAGATATGCCCATCTCCTGCAGAAAATAAC<br>ATCCAGGGAACCACAAAGCTAGCGTCTGGTGAAGAATTCTGTTCAGGTTCCAGCAG<br>CAATTTGCAAGCTCCTGGTGGCAGCTCTGAACGGTATTTAAAACAAATGAAATGAA<br>TGGTGCTTACTTCAAGCAAAGCTCAGTGTTCACTAAGGATTCCTTTTCTGCCACTACC<br>ACACCACCACCACCATCACAATTGCTTCTTTCTCCCCCTCCTCCTCTTCCACAGGTTCC<br>TCAGCTT (SEQ ID NO: 187) | |
| pARBI-968:<br>TET2_3_En<br>dogenous_<br>75 | GGAAAAAGCACTCTGAATGGTGGAGTTTTAGAAGAACACCACCACTACCCCAACCA<br>AAGTAACACAACACTTTTAAGGGAAGTGAAAATAGAGGGTAAACCTGAGGCACCAC<br>CTTCCCAGAGTCCTAATCCATCTACACATGTATGCAGCCCTTCTCCGATGCTTTCTGA<br>AAGGCCTCAGAATAATTGTGTGAACAGGAATGACATACAGACTGCAGGGACAATGA<br>CTGTTCCATTGTGTTCTGAGAAAACAAGACCAATGTCAGAACACCTCAAGCATAACC<br>CACCAATTTTTGGTAGCAGTGGAGAGCTACAGGACAACTGCCAGCAGTTGATGAGA<br>ACAAAGAGCAAGAGATTCTGAAGGGTCGAGACAAGGAGCAAACACGAGATCTTG<br>TGCCCCCAACACAGCACTATCTGAAACCAGGATGGATTGAATTGAAGGCCCCTCGTt<br>ccggatccggagagggcaggggatctctccttacttgtggcgacgtggaggagaacccccggccccATGGTG<br>AGCAAGGGCGAGGAGCTGTTCACCGGGGTGGTGCCCATCCTGGTCGAGCTGGACG<br>GCGACGTAAACGGCCACAAGTTCAGCGTGTCCGGCGAGGGCGAGGGCGATGCCAC<br>CTACGGCAAGCTGACCCTGAAGTTCATCTGCACCACCGGCAAGCTGCCCGTGCCCTG<br>GCCCACCCTCGTGACCACCCTGACCTACGGCGTGCAGTGCTTCAGCCGCTACCCCGA<br>CCACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatTTTCACCAAGCGGAATCCCATCTAAAACGTAATGAGGCATC<br>ACTGCCATCAATTCTTCAGTATCAACCCAATCTCTCCAATCAAATGACCTCCAAACAA<br>TACACTGGAAATTCCAACATGCCTGGGGGGCTCCCAAGGCAAGCTTACACCCAGAA<br>AACAACACAGCTGGAGCACAAGTCACAAATGTACCAAGTTGAAATGAATCAAGGGC<br>AGTCCCAAGGTACAGTGGACCAACATCTCCAGTTCCAAAAACCCTCACACCAGGTGC<br>ACTTCTCCAAAACAGACCATTTACCAAAAGCTCATGTGCAGTCACTGTGTGGCACTA<br>GATTTCATTTTCAACAAAGAGCAGATTCCCAAACTGAAAAACTTATGTCCCCAGTGTT<br>GAAACAGCACTTGAATCAACAGGCTTCAGAGACTGAGCCATTTTCAAACTCACACCT<br>TTTGCAACAT (SEQ ID NO: 188) | 1806 |
| pARBI-969:<br>TIGIT_1_En<br>dogenous_<br>76 | AAAGGGAGGTTGAGATGGGCTGAGGTCTTCTAGGAGGCGGGGAGGGAGTGCAGC<br>CTTGACAAGCCTCCCTGTGGGCGAGGTGTAAAGAGGGGCAGAAGTCAGCTCTGGA<br>AGCATAGGGCAGTGGGTGGGAGGAGATGGGCTGGGCTGGGCTGGAGTAGAGAT<br>GTGTGGAGAAGGGTGAGAAGACTGGAAAGACAACCTGAATGGGGGACTGGGAGC<br>CTTGAATAACAGGCATGGAGAGGAGCGTCTCTTGAAATGGAAGAAACAGGAAATA<br>ATTACAGCCTCTATGGAGGAGCAACAGGATGGACTGGAGAAACTATCATTCCAAAA<br>TCCAGTTGGGGCCTCAAAGGCCCTTAGAATTTTTCTAGGAAGGTTGAAGGCCAGCTG<br>CTGACCCAGGACTCACATGTGCTTCGTCCTCTTCCCTAGGAATGATGACAGGCACAA<br>TAGAAACAtccggatccggagagggcaggggatctctccttacttgtggcgacgtggaggagaacccccgg<br>ccccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcatttttttcactgcattctag<br>ttgtggtttgtccaaactcatcaatgtatcttatACGGGGAACATTTCTGCAGAGAAAGGTGGCT<br>CTATCATCTTACAATGTCACCTCTCCTCCACCACGGCACAAGTGACCCAGGTCAACTG<br>GGAGCAGCAGGACCAGCTTCGGCCATTTGTAATGCTGACTTGGGGTGGCACATCT<br>CCCCATCCTTCAAGGATCGAGTGGCCCCAGGTCCCGGCCTGGGCCTCACCCTCCAGT<br>CGCTGACCGTGAACGATACAGGGGAGTACTTCTGCATCTATCACACCTACCCTGATG | 1806 |

TABLE 5-continued

CONSTRUCTS USED FOR EVALUATION OF PREDICTED LOCI

| Construct name | Sequence | Length |
|---|---|---|
| | GGACGTACACTGGGAGAATCTTCCTGGAGGTCCTAGAAAGCTCAGGTATTCCTGCT<br>GGAGCAAGTTGGTGGATAAACCTCTCCCTCTAGCATAGAAAATGCAATCCTGAAACA<br>CTGCACAGCAGGGCTTCTCAATTCGGGATCACATTTGAATCACCTGAGGAGATTTTA<br>AATCATACTGATGCCGAGGCC (SEQ ID NO: 189) | |
| pARBI-970:<br>TIGIT_2_En<br>dogenous_<br>77 | GAGGAGATGGGCTGGGCTGGGCTGGAGTAGAGATGTGTGGAGAAGGGTGAGAAG<br>ACTGGAAAGACAACCTGAATGGGGGACTGGGAGCCTTGAATAACAGGCATGGAGA<br>GGAGCGTCTCTTGAAATGGAAGAAACAGGAAATAATTACAGCCTCTATGGAGGAGC<br>AACAGGATGGACTGGAGAAACTATCATTCCAAAATCCAGTTGGGGCCTCAAAGGCC<br>CTTAGAATTTTTCTAGGAAGGTTGAAGGCCAGCTGCTGACCCAGGACTCACATGTGC<br>TTCGTCCTCTTCCCTAGGAATGATGACAGGCACAATAGAAACAACGGGGAACATTTC<br>TGCAGAGAAAGGTGGCTCTATCATCTTACAATGTCACCTCTCCTCCACCACGGCACA<br>AGTGACCCAGGTCAACTGGGAGCAGCAGGACCAGCTTCTGGCCATTTGTAATGCTG<br>ACTccggatccggagagggcaggggatctctccttacttgtggcgacgtggaggagaaccccggccccATG<br>GTGAGCAAGGGCGAGGAGCTGTTCACCGGGGTGGTGCCCATCCTGGTCGAGCTGG<br>ACGGCGACGTAAACGGCCACAAGTTCAGCGTGTCCGGCGAGGGCGAGGGCGATGC<br>CACCTACGGCAAGCTGACCCTGAAGTTCATCTGCACCACCGGCAAGCTGCCCGTGCC<br>CTGGCCCACCCTCGTGACCACCCTGACCTACGGCGTGCAGTGCTTCAGCCGCTACCC<br>CGACCACATGAAGCAGCACGACTTCTTCAAGTCCGCCATGCCCGAAGGCTACGTCCA<br>GGAGCGCACCATCTTCTTCAAGGACGACGGCAACTACAAGACCCGCGCCGAGGTGA<br>AGTTCGAGGGCGACACCCTGGTGAACCGCATCGAGCTGAAGGGCATCGACTTCAAG<br>GAGGACGGCAACATCCTGGGGCACAAGCTGGAGTACAACTACAACAGCCACAACGT<br>CTATATCATGGCCGACAAGCAGAAGAACGGCATCAAGGTGAACTTCAAGATCCGCC<br>ACAACATCGAGGACGGCAGCGTGCAGCTCGCCGACCACTACCAGCAGAACACCCCC<br>ATCGGCGACGGCCCCGTGCTGCTGCCCGACAACCACTACCTGAGCACCCAGTCCAA<br>GCTGAGCAAAGACCCCAACGAGAAGCGCGATCACATGGTCCTGCTGGAGTTCGTGA<br>CCGCCGCCGGGATCACTCTCGGCATGGACGAGCTGTACAAAtgattgtttattgcagcttata<br>atggttacaaataaagcaatagcatcacaaatttcacaaataaagcatttttttcactgcattctagttgtggttt<br>gtccaaactcatcaatgtatcttatTTGGGGTGGCACATCTCCCCATCCTTCAAGGATCGAGT<br>GGCCCCAGGTCCCGGCCTGGGCCTCACCCTCCAGTCGCTGACCGTGAACGATACAG<br>GGGAGTACTTCTGCATCTATCACACCTACCCTGATGGGACGTACACTGGGAGAATCT<br>TCCTGGAGGTCCTAGAAAGCTCAGGTATTCCTGCTGGAGCAAGTTGGTGGATAAAC<br>CTCTCCCTCTAGCATAGAAAATGCAATCCTGAAACACTGCACAGCAGGGCTTCTCAA<br>TTCGGGATCACATTTGAATCACCTGAGGAGATTTTAAATCATACTGATGCCGAGGCC<br>TCACCCAGACCAATTCAATCAGAATCCCTAATAGCAGAGCTAAACAAGGGTAAGGTC<br>TAAAAGCATTTCCAGGTGATTCTAATGGGCAGCCAATACTGAGAACCACTGTTCTTA<br>TGTAAGAAGCACATC (SEQ ID NO: 190) | 1806 |
| pARBI-971:<br>TIGIT_3_En<br>dogenous_<br>78 | CCTCCCTGTGGGCGAGGTGTAAAGAGGGGCAGAAGTCAGCTCTGGAAGCATAGGG<br>CAGTGGGTGGGGAGGAGATGGGCTGGGCTGGGCTGGAGTAGAGATGTGTGGAGA<br>AGGGTGAGAAGACTGGAAAGACAACCTGAATGGGGGACTGGGAGCCTTGAATAAC<br>AGGCATGGAGAGGAGCGTCTCTTGAAATGGAAGAAACAGGAAATAATTACAGCCTC<br>TATGGAGGAGCAACAGGATGGACTGGAGAAACTATCATTCCAAAATCCAGTTGGGG<br>CCTCAAAGGCCCTTAGAATTTTTCTAGGAAGGTTGAAGGCCAGCTGCTGACCCAGGA<br>CTCACATGTGCTTCGTCCTCTTCCCTAGGAATGATGACAGGCACAATAGAAACAACG<br>GGGAACATTTCTGCAGAGAAAGGTGGCTCTATCATCTTACAATGTCACCTCTCCTCCA<br>CCtccggatccggagagggcaggggatctctccttacttgtggcgacgtggaggagaaccccggccccATG<br>GTGAGCAAGGGCGAGGAGCTGTTCACCGGGGTGGTGCCCATCCTGGTCGAGCTGG<br>ACGGCGACGTAAACGGCCACAAGTTCAGCGTGTCCGGCGAGGGCGAGGGCGATGC<br>CACCTACGGCAAGCTGACCCTGAAGTTCATCTGCACCACCGGCAAGCTGCCCGTGCC<br>CTGGCCCACCCTCGTGACCACCCTGACCTACGGCGTGCAGTGCTTCAGCCGCTACCC<br>CGACCACATGAAGCAGCACGACTTCTTCAAGTCCGCCATGCCCGAAGGCTACGTCCA<br>GGAGCGCACCATCTTCTTCAAGGACGACGGCAACTACAAGACCCGCGCCGAGGTGA<br>AGTTCGAGGGCGACACCCTGGTGAACCGCATCGAGCTGAAGGGCATCGACTTCAAG<br>GAGGACGGCAACATCCTGGGGCACAAGCTGGAGTACAACTACAACAGCCACAACGT<br>CTATATCATGGCCGACAAGCAGAAGAACGGCATCAAGGTGAACTTCAAGATCCGCC<br>ACAACATCGAGGACGGCAGCGTGCAGCTCGCCGACCACTACCAGCAGAACACCCCC<br>ATCGGCGACGGCCCCGTGCTGCTGCCCGACAACCACTACCTGAGCACCCAGTCCAA<br>GCTGAGCAAAGACCCCAACGAGAAGCGCGATCACATGGTCCTGCTGGAGTTCGTGA<br>CCGCCGCCGGGATCACTCTCGGCATGGACGAGCTGTACAAAtgattgtttattgcagcttata<br>atggttacaaataaagcaatagcatcacaaatttcacaaataaagcatttttttcactgcattctagttgtggttt<br>gtccaaactcatcaatgtatcttatACGGCACAAGTGACCCAGGTCAACTGGGAGCAGCAGG<br>ACCAGCTTCTGGCCATTTGTAATGCTGACTTGGGGTGGCACATCTCCCCATCCTTCAA<br>GGATCGAGTGGCCCCAGGTCCCGGCCTGGGCCTCACCCTCCAGTCGCTGACCGTGA<br>ACGATACAGGGGAGTACTTCTGCATCTATCACACCTACCCTGATGGGACGTACACTG<br>GGAGAATCTTCCTGGAGGTCCTAGAAAGCTCAGGTATTCCTGCTGGAGCAAGTTGG<br>TGGATAAACCTCTCCCTCTAGCATAGAAAATGCAATCCTGAAACACTGCACAGCAGG<br>GCTTCTCAATTCGGGATCACATTTGAATCACCTGAGGAGATTTTAAATCATACTGAT<br>GCCGAGGCCTCACCCAGACCAATTCAATCAGAATCCCTAATAGCAGAGCTAAACAAGG<br>GTAAGGTCTAAAAG (SEQ ID NO: 191) | 1806 |
| pARBI-972:<br>TRAC_1_En<br>dogenous_<br>79 | TAATGCCCAGCCTAAGTTGGGGAGACCACTCCAGATTCCAAGATGTACAGTTTGCTT<br>TGCTGGGCCTTTTTCCCATGCCTGCCTTTACTCTGCCAGAGTTATATTGCTGGGGTTT<br>TGAAGAAGATCCTATTAAATAAAAGAATAAGCAGTATTATTAAGTAGCCCTGCATTT<br>CAGGTTTCCTTGAGTGGCAGGCCAGGCCTGGCCGTGAACGTTCACTGAAATCATGG | 1806 |

TABLE 5-continued

CONSTRUCTS USED FOR EVALUATION OF PREDICTED LOCI

| Construct name | Sequence | Length |
|---|---|---|
| | CCTCTTGGCCAAGATTGATAGCTTGTGCCTGTCCCTGAGTCCCAGTCCATCACGAGC<br>AGCTGGTTTCTAAGATGCTATTTCCCGTATAAAGCATGAGACCGTGACTTGCCAGCC<br>CCACAGAGCCCCGCCCTTGTCCATCACTGGCATCTGGACTCTGGGTTGGGGC<br>AAAGAGGGAAATGAGATCATGTCCTAACCCTGATCCTCTTGTCCCACAGATtccggatc<br>cggagagggcaggggatctctccttacttgtggcgacgtggaggagaaccccggccccATGGTGAGCAA<br>GGGCGAGGAGCTGTTCACCGGGGTGGTGCCCATCCTGGTCGAGCTGGACGGCGAC<br>GTAAACGGCCACAAGTTCAGCGTGTCCGGCGAGGGCGAGGGCGATGCCACCTACG<br>GCAAGCTGACCCTGAAGTTCATCTGCACCACCGGCAAGCTGCCCGTGCCCTGGCCCA<br>CCCTCGTGACCACCCTGACCTACGGCGTGCAGTGCTTCAGCCGCTACCCCGACCACA<br>TGAAGCAGCACGACTTCTTCAAGTCCGCCATGCCCGAAGGCTACGTCCAGGAGCGC<br>ACCATCTTCTTCAAGGACGACGGCAACTACAAGACCCGCGCCGAGGTGAAGTTCGA<br>GGGCGACACCCTGGTGAACCGCATCGAGCTGAAGGGCATCGACTTCAAGGAGGAC<br>GGCAACATCCTGGGGCACAAGCTGGAGTACAACTACAACAGCCACAACGTCTATAT<br>CATGGCCGACAAGCAGAAGAACGGCATCAAGGTGAACTTCAAGATCCGCCACAACA<br>TCGAGGACGGCAGCGTGCAGCTCGCCGACCACTACCAGCAGAACACCCCCATCGGC<br>GACGGCCCCGTGCTGCTGCCCGACAACCACTACCTGAGCACCCAGTCCAAGCTGAG<br>CAAAGACCCCAACGAGAAGCGCGATCACATGGTCCTGCTGGAGTTCGTGACCGCCG<br>CCGGGATCACTCTCGGCATGGACGAGCTGTACAAatgattgtttattgcagcttataatggttac<br>aaataaagcaatagcatcacaaatttcacaaataaagcattttttcactgcattctagttgtggtttgtccaaac<br>tcatcaatgtatcttatATCCAGAaccctgacctgccgtgtaccagctgagagactctaaa<br>TCCAGTGACAAGTCTGTCTGCCTATTCACCGATTTTGATTCTCAAACAAATGTGTCAC<br>AAAGTAAGGATTCTGATGTGTATATCACAGACAAAACTGTGCTAGACATGAGGTCTA<br>TGGACTTCAAGAGCAACAGTGCTGTGGCCTGGAGCAACAAATCTGACTTTGCATGT<br>GCAAACGCCTTCAACAACAGCATTATTCCAGAAGACACCTTCTTCCCCAGCCCAGGT<br>AAGGGCAGCTTTGGTGCCTTCGCAGGCTGTTTCCTTGCTTCAGGAATGGCCAGGTTC<br>TGCCCAGAGCTCTGGTCAATGATGTCTAAAACTCCTCTGATTGGTGGTCTCGGCCTTA<br>TCCATTGCCACCAAAACCCTCTTTTACTAAGAAACAGTGAGCCTTGTTCTGGCAGTC<br>CAGA (SEQ ID NO: 192) | |
| pARBI-973: TRAC_2_En dogenous_ 80 | GATTCCAAGATGTACAGTTTGCMGCTGGGCCTTTTTCCCATGCCTGCCTTTACTCTG<br>CCAGAGTTATATTGCTGGGGTTTTGAAGAAGATCCTATTAAATAAAAGAATAAGCAG<br>TATTATTAAGTAGCCCTGCATTTCAGGTTTCCTTGAGTGGCAGGCCAGGCCTGGCCG<br>TGAACGTTCACTGAAATCATGGCCTCTTGGCCAAGATTGATAGCTTGTGCCTGTCCCT<br>GAGTCCCAGTCCATCACGAGCAGCTGGTTTCTAAGATGCTATTTCCCGTATAAAGCA<br>TGAGACCGTGACTTGCCAGCCCCACAGAGCCCCGCCCTTGTCCATCACTGGCATCTG<br>GACTCCAGCTGGGTTGGGGCAAAGAGGGAAATGAGATCATGTCCTAACCCTGATC<br>CTCTTGTCCCACAGATATCCAGAACCCTGACCCTGCCGTGTACCAGCTGtccggatccgg<br>agagggcaggggatctctccttacttgtggcgacgtggaggagaaccccggccccATGGTGAGCAAGG<br>GCGAGGAGCTGTTCACCGGGGTGGTGCCCATCCTGGTCGAGCTGGACGGCGACGT<br>AAACGGCCACAAGTTCAGCGTGTCCGGCGAGGGCGAGGGCGATGCCACCTACGGC<br>AAGCTGACCCTGAAGTTCATCTGCACCACCGGCAAGCTGCCCGTGCCCTGGCCCACC<br>CTCGTGACCACCCTGACCTACGGCGTGCAGTGCTTCAGCCGCTACCCCGACCACATG<br>AAGCAGCACGACTTCTTCAAGTCCGCCATGCCCGAAGGCTACGTCCAGGAGCGCAC<br>CATCTTCTTCAAGGACGACGGCAACTACAAGACCCGCGCCGAGGTGAAGTTCGAGG<br>GCGACACCCTGGTGAACCGCATCGAGCTGAAGGGCATCGACTTCAAGGAGGACGG<br>CAACATCCTGGGGCACAAGCTGGAGTACAACTACAACAGCCACAACGTCTATATCAT<br>GGCCGACAAGCAGAAGAACGGCATCAAGGTGAACTTCAAGATCCGCCACAACATCG<br>AGGACGGCAGCGTGCAGCTCGCCGACCACTACCAGCAGAACACCCCCATCGGCGAC<br>GGCCCCGTGCTGCTGCCCGACAACCACTACCTGAGCACCCAGTCCAAGCTGAGCAA<br>AGACCCCAACGAGAAGCGCGATCACATGGTCCTGCTGGAGTTCGTGACCGCCGCCG<br>GGATCACTCTCGGCATGGACGAGCTGTACAAatgattgtttattgcagcttataatggttacaaat<br>aaagcaatagcatcacaaatttcacaaataaagcattttttcactgcattctagttgtggtttgtccaaactcat<br>caatgtatcttatAGAGACTCTAAATCCAGTGACAAGTCTGTCTGCCTATTCACCGATTTT<br>GATTCTCAAACAAATGTGTCACAAAGTAAGGATTCTGATGTGTATATCACAGACAAA<br>ACTGTGCTAGACATGAGGTCTATGGACTTCAAGAGCAACAGTGCTGTGGCCTGGAG<br>CAACAAATCTGACTTTGCATGTGCAAACGCCTTCAACAACAGCATTATTCCAGAAGA<br>CACCTTCTTCCCCAGCCCAGGTAAGGGCAGCTTTGGTGCCTTCGCAGGCTGTTTCCTT<br>GCTTCAGGAATGGCCAGGTTCTGCCCAGAGCTCTGGTCAATGATGTCTAAAACTCCT<br>CTGATTGGTGGTCTCGGCCTTATCCATTGCCACCAAAACCCTCTTTTTACTAAGAAAC<br>AGTGAGCCTTGTTCTGGCAGTCCAGAGAATGACACGGGAAAAAAGCAGATGAAGA<br>GAAG (SEQ ID NO: 193) | 1806 |
| pARBI-974: TRAC_3_En dogenous_ 81 | TTCCTGTGGTAGCGGAACTCACTAAGGGGCCCATCTCGGACCCGAGGTATTGTGATG<br>ATAAATTCTGAGCACCTACCCCATCCCCAGAAGGGCTCAGAAATAAAATAAGAGCCA<br>AGTCTAGTCGGTGTTTCCTGTCTTGAAACACAATACTGTTGGCCCTGGAAGAATGCA<br>CAGAATCTGTTTGTAAGGGGATATGCACAGAAGCTGCAAGGGACAGGAGGTGCAG<br>GAGCTGCAGGCCTCCCCCACCCAGCCTGCTCTGCCTTGGGGAAAACCGTGGGTGTG<br>TCCTGCAGGCCATGCAGGCCTGGGACATGCAAGCCCATAACCGCTGTGGCCTCTTG<br>GTTTTACAGATACGAACCTAAACTTTCAAAACCTGTCAGTGATTGGGTTCCGAATCCT<br>CCTCCTGAAAGTGGCCGGGTTTAATCTGCTCATGACGCTGTGGTCCAGCtcc<br>ggatccggagagggcaggggatctctccttacttgtggcgacgtggaggagaaccccggccccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC | 1806 |

TABLE 5-continued

CONSTRUCTS USED FOR EVALUATION OF PREDICTED LOCI

| Construct name | Sequence | Length |
|---|---|---|
| | CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAtgattgtttattgcagcttataatgg<br>ttacaaataaagcaatagcatcacaaatttcacaaataaagcattttttcactgcattctagttgtggtttgtcc<br>aaactcatcaatgtatcttatTGAGGTGAGGGGCCTTGAAGCTGGGAGTGGGGTTTAGGGA<br>CGCGGGTCTCTGGGTGCATCCTAAGCTCTGAGAGCAAACCTCCCTGCAGGGTCTTGC<br>TTTTTAAGTCCAAAGCCTGAGCCCACCCAAACTCTCCTACTTCTTCCTGTTACAAATTCCT<br>CTTGTGCAATAATAATGCCTGAAACGCTGTAAAATATCCTCATTTCAGCCGCCTCAG<br>TTGCACTTCTCCCCTATGAGGTAGGAAGAACAGTTGTTTAGAAACGAAGAAACTGA<br>GGCCCCACAGCTAATGAGTGGAGGAAGAGAGACACTTGTGTACACCACATGCCTTG<br>TGTTGTACTTCTCTCACCGTGTAACCTCCTCATGTCCTCTCTCCCCAGTACGGCTCTCT<br>TAGCTCAGTAGAAAGAAGACATTACACTCATATTACACCCCAATCCTGGCTAGAGTC<br>TCCGCACC (SEQ ID NO: 194) | |
| pARBI-975:<br>TRAC_4_En<br>dogenous_<br>82 | ATTATTAAGTAGCCCTGCATTTCAGGTTTCCTTGAGTGGCAGGCCAGGCCTGGCCGT<br>GAACGTTCACTGAAATCATGGCCTCTTGGCCAAGATTGATAGCTTGTGCCTGTCCCT<br>GAGTCCCAGTCCATCACGAGCAGCTGGTTTCTAAGATGCTATTTCCCGTATAAAGCA<br>TGAGACCGTGACTTGCCAGCCCCACAGAGCCCCGCCCTTGTCCATCACTGGCATCTG<br>GACTCCAGCCTGGGTTGGGGCAAAGAGGGAAATGAGATCATGTCCTAACCCTGATC<br>CTCTTGTCCCACAGATATCCAGAACCCTGACCCTGCCGTGTACCAGCTGAGAGACTC<br>TAAATCCAGTGACAAGTCTGTCTGCCTATTCACCGATTTTGATTCTCAAACAAATGTG<br>TCACAAAGTAAGGATTCTGATGTGTATATCACAGACAAAACTGTGCTAGACtccggatc<br>cggagagggcagggatctctccttacttgtggcgacgtggaggagaaccccggccccATGGTGAGCAA<br>GGGCGAGGAGCTGTTCACCGGGGTTGGTGCCCATCCTGGTCGAGCTGGACGGCGAC<br>GTAAACGGCCACAAGTTCAGCGTGTCCGGCGAGGGCGAGGGCGATGCCACCTACG<br>GCAAGCTGACCCTGAAGTTCATCTGCACCACCGGCAAGCTGCCCGTGCCCTGGCCCA<br>CCCTCGTGACCACCCTGACCTACGGCGTGCAGTGCTTCAGCCGCTACCCCGACCACA<br>TGAAGCAGCACGACTTCTTCAAGTCCGCCATGCCCGAAGGCTACGTCCAGGAGCGC<br>ACCATCTTCTTCAAGGACGACGGCAACTACAAGACCCGCGCCGAGGTGAAGTTCGA<br>GGGCGACACCCTGGTGAACCGCATCGAGCTGAAGGGCATCGACTTCAAGGAGGAC<br>GGCAACATCCTGGGGCACAAGCTGGAGTACAACTACAACAGCCACAACGTCTATAT<br>CATGGCCGACAAGCAGAAGAACGGCATCAAGGTGAACTTCAAGATCCGCCACAACA<br>TCGAGGACGGCAGCGTGCAGCTCGCCGACCACTACCAGCAGAACACCCCCATCGGC<br>GACGGCCCCGTGCTGCTGCCCGACAACCACTACCTGAGCACCCAGTCCAAGCTGAG<br>CAAAGACCCCAACGAGAAGCGCGATCACATGGTCCTGCTGGAGTTCGTGACCGCCG<br>CCGGGATCACTCTCGGCATGGACGAGCTGTACAAAtgattgtttattgcagcttataatggttac<br>aaataaagcaatagcatcacaaatttcacaaataaagcattttttcactgcattctagttgtggtttgtccaaac<br>tcatcaatgtatcttatATGAGGTCTATGGACTTCAAGAGCAACAGTGCTGTGGCCTGGAG<br>CAACAAATCTGACTTTGCATGTGCAAACGCCTTCAACAACAGCATTATTCCAGAAGA<br>CACCTTCTTCCCCAGCCCAGGTAAGGGCAGCTTTGGTGCCTTCGCAGGCTGTTTCCTT<br>GCTTCAGGAATGGCCAGGTTCTGCCCAGAGCTCTGGTCAATGATGTCTAAAACTCCT<br>CTGATTGGTGGTCTCGGCCTTATCCATTGCCACCAAAACCCTCTTTTTACTAAGAAAC<br>AGTGAGCCTTGTTCTGGCAGTCCAGAGAATGACACGGGAAAAAGCAGATGAAGA<br>GAAGGTGGCAGGAGAGGGCACGTGGCCCAGCCTCAGTCTCTCAACTGAGTTCCTG<br>CCTGCCTGCCTTTGCTCAGACTGTTTGCCCCTTACTGCTCTTCTAGGCCTCATTCTAAG<br>CCCCTT (SEQ ID NO: 195) | 1806 |
| pARBI-976:<br>TRAC_6_En<br>dogenous_<br>84 | TTCATTTCCATTTGAGTTGTTCTTATTGAGTCATCCTTCCTGTGGTAGCGGAACTCACT<br>AAGGGGCCCATCTGGACCCGAGGTATTGTGATGATAAATTCTGAGCACCTACCCCAT<br>CCCCAGAAGGGCTCAGAAATAAAATAAGAGCCAAGTCTAGTCGGTGTTTCCTGTCTT<br>GAAACACAATACTGTTGGCCCTGGAAGAATGCACAGAATCTGTTTGTAAGGGGATA<br>TGCACAGAAGCTGCAAGGGACAGGAGGTGCAGGAGCTGCAGGCCTCCCCCACCCA<br>GCCTGCTCTGCCTTGGGGAAAACCGTGGGTGTGTCCTGCAGGCCATGCAGGCCTGG<br>GACATGCAAGCCCATAACCGCTGTGGCCTCTTGGTTTTACAGATACGAACCTAAACT<br>TTCAAAACCTGTCAGTGATTGGGTTCCGAATCCTCCTCCTGAAAGTGGCCGGGtccgg<br>atccggagagggcagggatctctccttacttgtggcgacgtggaggagaaccccggccccATGGTGAGC<br>AAGGGCGAGGAGCTGTTCACCGGGGTTGGTGCCCATCCTGGTCGAGCTGGACGGCGA<br>CGTAAACGGCCACAAGTTCAGCGTGTCCGGCGAGGGCGAGGGCGATGCCACCTA<br>CGGCAAGCTGACCCTGAAGTTCATCTGCACCACCGGCAAGCTGCCCGTGCCCTGGCC<br>CACCCTCGTGACCACCCTGACCTACGGCGTGCAGTGCTTCAGCCGCTACCCCGACCA<br>CATGAAGCAGCACGACTTCTTCAAGTCCGCCATGCCCGAAGGCTACGTCCAGGAGC<br>GCACCATCTTCTTCAAGGACGACGGCAACTACAAGACCCGCGCCGAGGTGAAGTTC<br>GAGGGCGACACCCTGGTGAACCGCATCGAGCTGAAGGGCATCGACTTCAAGGAGG<br>ACGGCAACATCCTGGGGCACAAGCTGGAGTACAACTACAACAGCCACAACGTCTAT<br>ATCATGGCCGACAAGCAGAAGAACGGCATCAAGGTGAACTTCAAGATCCGCCACAA<br>CATCGAGGACGGCAGCGTGCAGCTCGCCGACCACTACCAGCAGAACACCCCCATCG<br>GCGACGGCCCCGTGCTGCTGCCCGACAACCACTACCTGAGCACCCAGTCCAAGCTG<br>AGCAAAGACCCCAACGAGAAGCGCGATCACATGGTCCTGCTGGAGTTCGTGACCGC<br>CGCCGGGATCACTCTCGGCATGGACGAGCTGTACAAAtgattgtttattgcagcttataatggt | 1806 |

TABLE 5-continued

CONSTRUCTS USED FOR EVALUATION OF PREDICTED LOCI

| Construct name | Sequence | Length |
|---|---|---|
| | tacaaataaagcaatagcatcacaaatttcacaaataaagcattttttttcactgcattctagttgtggtttgtcca<br>aactcatcaatgtatcttatTTTAATCTGCTCATGACGCTGCGGCTGTGGTCCAGCTGAGGT<br>GAGGGGCCTTGAAGCTGGGAGTGGGGTTTAGGGACGCGGGTCTCTGGGTGCATCC<br>TAAGCTCTGAGAGCAAACCTCCCTGCAGGGTCTTGCTTTTAAGTCCAAAGCCTGAGC<br>CCACCAAACTCTCCTACTTCTTCCTGTTACAAATTCCTCTTGTGCAATAATAATGGCCT<br>GAAACGCTGTAAAATATCCTCATTTCAGCCGCCTCAGTTGCACTTCTCCCCTATGAGG<br>TAGGAAGAACAGTTGTTTAGAAACGAAGAAACTGAGGCCCCACAGCTAATGAGTGG<br>AGGAAGAGAGACACTTGTGTACACCACATGCCTTGTGTTGTACTTCTCTCACCGTGT<br>AACCTCCTCATGTCCTCTCTCCCAGTACGGCTCTGTTAGCTCAGTAGAAAGAAGACA<br>TTACACTC (SEQ ID NO: 196) | |
| pARBI-977:<br>TRAC_Endo<br>genous_83 | CAGTCCATCACGAGCAGCTGGTTTCTAAGATGCTATTTCCCGTATAAAGCATGAGAC<br>CGTGACTTGCCAGCCCCACAGAGCCCCGCCCTTGTCCATCACTGGCATCTGGACTCC<br>AGCCTGGGTTGGGGCAAAGAGGGAAATGAGATCATGTCCTAACCCTGATCCTCTTG<br>TCCCACAGATATCCAGAACCCTGACCCTGCCGTGTACCAGCTGAGAGACTCTAAATC<br>CAGTGACAAGTCTGTCTGCCTATTCACCGATTTTGATTCTCAAACAAATGTGTCACAA<br>AGTAAGGATTCTGATGTGTATATCACAGACAAAACTGTGCTAGACATGAGGTCTATG<br>GACTTCAAGAGCAACAGTGCTGTGGCCTGGAGCAACAAATCTGACTTTGCATGTGC<br>AAACGCCTTCAACAACAGCATTATTCCAGAAGACACCTTCTTCCCCAGCCCAtccggatc<br>cggagagggcaggggatctctccttacttgtggcgacgtggaggagaaccccggccccATGGTGAGCAA<br>GGGCGAGGAGCTGTTCACCGGGGTGGTGCCCATCCTGGTCGAGCTGGACGGCGAC<br>GTAAACGGCCACAAGTTCAGCGTGTCCGGCGAGGGCGAGGGCGATGCCACCTACG<br>GCAAGCTGACCCTGAAGTTCATCTGCACCACCGGCAAGCTGCCCGTGCCCTGGCCCA<br>CCCTCGTGACCACCCTGACCTACGGCGTGCAGTGCTTCAGCCGCTACCCCGACCACA<br>TGAAGCAGCACGACTTCTTCAAGTCCGCCATGCCCGAAGGCTACGTCCAGGAGCGC<br>ACCATCTTCTTCAAGGACGACGGCAACTACAAGACCCGCGCCGAGGTGAAGTTCGA<br>GGGCGACACCCTGGTGAACCGCATCGAGCTGAAGGGCATCGACTTCAAGGAGGAC<br>GGCAACATCCTGGGGCACAAGCTGGAGTACAACTACAACAGCCACAACGTCTATAT<br>CATGGCCGACAAGCAGAAGAACGGCATCAAGGTGAACTTCAAGATCCGCCACAACA<br>TCGAGGACGGCAGCGTGCAGCTCGCCGACCACTACCAGCAGAACACCCCCATCGGC<br>GACGGCCCCGTGCTGCTGCCCGACAACCACTACCTGAGCACCCAGTCCAAGCTGAG<br>CAAAGACCCCAACGAGAAGCGCGATCACATGGTCCTGCTGGAGTTCGTGACCGCCG<br>CCGGGATCACTCTCGGCATGGACGAGCTGTACAAatgattgtttattgcagcttataatggttac<br>aaataaagcaatagcatcacaaatttcacaaataaagcattttttttcactgcattctagttgtggtttgtccaaac<br>tcatcaatgtatcttatGGTAAGGGCAGCTTTGGTGCCTTCGCAGGCTGTTTCCTTGCTTCA<br>GGAATGGCCAGGTTCTGCCCAGAGCTCTGGTCAATGATGTCTAAAACTCCTCTGATT<br>GGTGGTCTCGGCCTTATCCATTGCCACCAAAACCCTCTTTTTACTAAGAAACAGTGAG<br>CCTTGTTCTGGCAGTCCAGAGAATGACACGGGAAAAAAGCAGATGAAGAGAAGGT<br>GGCAGGAGAGGGCACGTGGCCCAGCCTCAGTCTCTCCAACTGAGTTCCTGCCTGCCT<br>GCCTTTGCTCAGACTGTTTGCCCCTTACTGCTCTTCTAGGCCTCATTCTAAGCCCCTTC<br>TCCAAGTTGCCTCTCCTTATTTCTCCCTGTCTGCCAAAAAATCTTTCCCAGCTCACTAA<br>GTCAGTCTCACGCAGTCACTCATTAACCCACCAATCACTGATTGTGCCGGCACATGA<br>ATG (SEQ ID NO: 197) | 1806 |
| pARBI-978:<br>TRIM28_1_<br>Endogenou<br>s_85 | TGAGGAAGAAGCGCGGGCGGCGCCTTCGGGAGGCGAGCAGGCAGCAGTTGGCCG<br>TGCCGTAGCAGCGTCCCGCGCGCGGCGGGCAGCGGCCCAGGAGGCGCGTGGCGGC<br>GCTCGGCCTCGCGGCGGCGGCGGCAGCGGCCCAGCAGTTGGCGGCGAGCGCG<br>TCTGCGCCTGCGCGGCGGGCCCCGCGCCCCTCCTCCCCCCTGGGCGCCCCGGCGG<br>CGTGTGAATGGCGGCCTCCGCGGCGGCAGCCTCGGCAGCAGCGGCCTCGGCCGCCT<br>CTGGCAGCCCGGGCCCGGGCGAGGGCTCCGCTGGCGGCGAAAAGCGCTCCACCGC<br>CCCCTTCGGCCGCAGCCTCGGCCTCTGCCTCAGCCGCGGCGTCGTCGCCCGCGGGG<br>GCGGCGCCGAGGCGCTGGAGCTGCTGGAGCACTGCGGCGTGTGCAGAGAGCGCCT<br>GCGACCCtccggatccggagagggcaggggatctctccttacttgtggcgacgtggaggagaaccccggcc<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGC<br>ATGCCACCTACGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcattttttttcactgcattctagttg<br>tggtttgtccaaactcatcaatgtatcttatGAGAGGGAGCCCCGCTGCCCTGTTTGCACT<br>CGGCCTGTAGTGCCTGCTTAGGGCCCGCGGCCCCCGCCGCCGCCCAACAGCTCGGG<br>GACGCGGGGCGGCGGCGACGGCACCGGTAAGTACGAAGTGATCGGTGCCACCC<br>CTCCCCCTACTCTCTGCCTTTGATTCCGACTGGGTGCAGAGATGAGGATGCCACCTG<br>GGCGAGAGGATGGGGCCCGGACAGGGCACGGGAAATACTTTCTGGGTCCTGCAT<br>ACGAACGTGGGTTTGTGCTGGCCGCTGAGATGGACATCTGACTAAAGTTGGAGAA | 1806 |

TABLE 5-continued

CONSTRUCTS USED FOR EVALUATION OF PREDICTED LOCI

| Construct name | Sequence | Length |
|---|---|---|
| | AAGAAGGCTCGGGGAGGGGAGGGGCTGGTTCGCTGCGGGATAATGGTCGGGGGC<br>CCACCCAGCAGGGGAATGGTGGGGGCCATAACCTGGGTGGGAACTTGTAACAGTCT<br>CCCACATCCCTGCTTCTCGAAGTGGTG (SEQ ID NO: 198) | |
| pARBI-979:<br>TRIM28_2_<br>Endogenou<br>s_86 | TCGAAGTGGTGGACTGTCCCGTGTGCAAGCAACAGTGCTTCTCCAAAGACATCGTG<br>GAGAATTATTTCATGCGTGATAGTGGCAGCAAGGCTGCCACCGACGCCCAGGATGC<br>GAACCAGGTGCGTCCTATCTCAGCAACCACAAGGAGGTTTCTGGGGAGGGGGCATC<br>TGCGCAGGAGGAGCTTGGCACCAGCTCCAGGCTGTTACTCCACTTTCCCAAGGCTCT<br>GGGTGGGCTGCCTAGGTTGGGTCAAGGGACCAATCTTAAATCTCCGGTTGTATTTTC<br>TGGGATGTAAACGTGGATCTATCAAGTTGTCTTGCCTTCTCTGACCCTGCCTTTGTCT<br>GGCAGTGCTGCACTAGCTGTGAGGATAATGCCCCAGCCACCAGCTACTGTGTGGAG<br>TGCTCGGAGCCTCTGTGTGAGACCTGTGTAGAGGCGCACCAGCGGGTGAAGTACtcc<br>ggatccggagagggcagggatctctccttacttgtggcgacgtggaggagaaccccggcccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAtgattgtttattgcagcttataatgg<br>ttacaaataaagcaatagcatcacaaatttcacaaataaagcattttttcactgcattctagttgtggtttgtcc<br>aaactcatcaatgtatcttatACCAAGGACCATACTGTGCGCTCTACTGGTACATGAGGCTG<br>AGGGGGGCTGTTGGAGTTGTTCTCCCATGTGTGCCCTCAGTTGCTTTTATGATGTTG<br>GTTGCATCTGGTGGATGGGTCCTAGAGTTCTCTAGGGGGTGCCGCCCGAAGGGCCC<br>GAGGGCAGAACTCCAGAAGCAGAAAACTGGGGGTTGTGGTGTGTAGTCTCTAGGG<br>CCTAGGTGGGAGAGGGTGGGAAGGGGAAATAAGGGAGACCTTAATGTGCTGCAG<br>GGAGGTACAAAGGGTTTGAGAAGGCTTATCAGGGAGTTGTCAGACCTGGTGGTGA<br>AGGGCTCAGCATATGCAAACAGGGAAAGGCATGGTGTGAAGGGCTTTCTGGGTTTG<br>TGGTTCCCTGGCACACATCTGGTATAAGATGCTGCTAGGGAAAGTAGACTGTGGGT<br>CCATGGATTATAAGTGATGA (SEQ ID NO: 199) | 1806 |
| pARBI-980:<br>TRIM28_3_<br>Endogenou<br>s_87 | GGCGCCCAATGCGCGTGCGCGGCGGCGTCGGCGCCAGTTATTTCTGTCCCGCCCCCC<br>GGCCTCGGCTCTTTCTGCGAGCGGGCGCGCGGGCGAGCGGTTGTGCTTGTGCTTGT<br>GGCGCGTGGTGCGGGTTTCGGCGGCGGCTGAGGAAGAAGCGCGGGCGGCGCCTTC<br>GGGAGGCGAGCAGGCAGCAGTTGGCCGTGCCGTAGCAGCGTCCCGCGCGGCGGCG<br>GCAGCGGCCCAGGAGGCGCGTGGCGGCGCTCGGCCTCGCGGCGGCGGCGGC<br>AGCGGCCCAGCAGTTGGCGGCGAGCGCGTCTGCGCCTGCGCGGCGGGCCCCGCGC<br>CCCTCCTCCCCCCTGGGCGCCCCCGGCGGCGTGTGAATGGCGGCCTCCGCGGCGG<br>CAGCCTCGGCAGCAGCGGCCTCGGCCGCCTCTGGCAGCCCGGGCCCGGGCGAGGG<br>CTCCGCTTccggatccggagagggcagggggatctctccttacttgtggcgacgtggaggagaaccccggcc<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAAtgattgtttattgcag<br>cttataatggttacaaataaagcaatagcatcacaaatttcacaaataaagcattttttcactgcattctagttg<br>tggtttgtccaaactcatcaatgtatcttatGGCGGCGAAAAGCGCTCCACCGCCCCTTCGGCCG<br>CAGCCTCGGCCTCTGCCTCAGCCGCGGCGTCGTCGCCCGCGGGGGCGGCGCCGAG<br>GCGCTGGAGCTGCTGGAGCACTGCGGCGTGTGCAGAGAGCGCCTGCGACCCCGAGA<br>GGGAGCCCCGCCTGCTGCCCGTGTTTGCACTCGGCCTGTAGTGCCTGCTTAGGGCCCG<br>CGGCCCCCGCCGCCGCCAACAGCTCGGGGGACGGCGGGGCGGCGGGCGACGGCA<br>CCGGTAAGTACGAAGTGATCGGTGCCACCCCTCCCCCTACTCTCTGCCTTTGATTCCG<br>ACTGGGTGCAGAGATGAGGATGCCACCTGGGCGAGAGGATGGGGGCCCGGACAG<br>GGCACGGGAAATACTTTCTGGGTCCTGCATACGAACGTGGGTTTGTGCTGGCCGCT<br>GAGATGGGACATCTGACTAAAGTTGG (SEQ ID NO: 200) | 1806 |
| pARBI-596:<br>APRT_LEx<br>ogenous_1 | ATCTCGGCCAATAAAGGAGAAAGGGCGCGGCCCGTACGCGCGCCAGGTGCGTGGG<br>CGAGACCAGCTCACGCCCCTCCTCCAGCCGCCAAGGCCCCGGCCCACAGCTGCCTGG<br>CTGCAGTCAGAAGCGTAGCCCGAGACAAGGAAGGGCGCCTTGACTCGCACTTTTGT<br>CCGGTTCGAACGTTCTGctcagtggtgcgtggaatgcgagcgcgtcttaaaatcgatggcgcctaggag<br>tccatgaaatacggTACAGGCTTCCGGCGACGGATGCCCCGCCCCTCACCCACGCTCCGC | 2541 |

TABLE 5-continued

CONSTRUCTS USED FOR EVALUATION OF PREDICTED LOCI

| Construct name | Sequence | Length |
|---|---|---|
| | CCTCCGGGGATGCCCCACCCCTCGTGGCGGTCCCGCCCGTCCCCGCGCAGGCGCGCT<br>CGGGCTGCCGCTGGCTCTTCGCACGCGGCCATGGCCGACTCCGAGCTGCAGCTGGT<br>TGAGCAGCGGATCCGCAGCTTCCCCGACTTCCCCACCCCAtgacgactgtgccttctagttgc<br>cagccatctgttgtttgcccctcccccgtgccttccttgaccctggaaggtgccactcccactgtcctttcctaata<br>aaatgaggaaattgcatcgcattgtctgagtaggtgtcattctattctgggggtggggtggggcaggacagca<br>agggggaggattgggaagacaatagcaggcatgctggggatgcggtgggctctatggGGATCTGCGAT<br>CGCTCCGGTGCCCGTCAGTGGGCAGAGCGCACATCGCCCACAGTCCCCGAGAAGTT<br>GGGGGGAGGGGTCGGCAATTGAACGGGTGCCTAGAGAAGGTGGCGCGGGGTAAA<br>CTGGGAAAGTGATGTCGTGTACTGGCTCCGCCTTTTTCCCGAGGGTGGGGGAGAAC<br>CGTATATAAGTGCAGTAGTCGCCGTGAACGTTCTTTTTCGCAACGGGTTTGCCGCCA<br>GAACACAGCTGAAGCTTCGAGGGGCTCGCATCTCTCCTTCACGCGCCCGCCGCCCTA<br>CCTGAGGCCGCCATCCACGCCGGTTGAGTCGCGTTCTGCCGCCTCCCGCCTGTGGTG<br>CCTCCTGAACTGCGTCCGCCGTCTAGGTAAGTTTAAAGCTCAGGTCGAGACCGGGCC<br>TTTGTCCGGCGCTCCCTTGGAGCCTACCTAGACTCAGCCGGCTCTCCACGCTTTGCCT<br>GACCCTGCTTGCTCAACTCTACGTCTTTGTTTCGTTTTCTGTTCTGCGCCGTTACAGAT<br>CCAAGCTGTGACCGGCGCCTACTCTAGAGCTAGCGAATTgccgccaccATGGTGAGCA<br>AGGGCGAGGAGCTGTTCACCGGGGTGGTGCCCATCCTGGTCGAGCTGGACGGCGA<br>CGTAAACGGCCACAAGTTCAGCGTGTCCGGCGAGGGCGAGGGCGATGCCACCTAC<br>GGCAAGCTGACCCTGAAGTTCATCTGCACCACCGGCAAGCTGCCCGTGCCCTGGCCC<br>ACCCTCGTGACCACCCTGACCTACGGCGTGCAGTGCTTCAGCCGCTACCCCGACCAC<br>ATGAAGCAGCACGACTTCTTCAAGTCCGCCATGCCCGAAGGCTACGTCCAGGAGCG<br>CACCATCTTCTTCAAGGACGACGGCAACTACAAGACCCGCGCCGAGGTGAAGTTCG<br>AGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATA<br>TCATGGCCGACAAGCAGAAGAACGGCATCAAGGTGAACTTCAAGATCCGCCACAAC<br>ATCGAGGACGGCAGCGTGCAGCTCGCCGACCACTACCAGCAGAACACCCCCATCGG<br>CGACGGCCCCGTGCTGCTGCCCGACAACCACTACCTGAGCACCCAGTCCAAGCTGA<br>GCAAAGACCCCAACGAGAAGCGCGATCACATGGTCCTGCTGGAGTTCGTGACCGCC<br>GCCGGGATCACTCTCGGCATGGACGAGCTGTACAAatgattgtttattgcagcttataatggtt<br>acaaataaagcaatagcatcacaaatttcacaaataaagcatttttttcactgcattctagttgtggtttgtccaa<br>actcatcaatgtatcttatGGCGTGGTATTCAGGTGCACGCACAGGCCGCCCTCGTGGCGC<br>CCCGACCTGCGGGCCTACGGATGGGAGCGCGTGGCCCGCGACCTCCGGGCGGGCG<br>GGGCGGGAACCCTCGTCTTTCGCCCCCGGGGCCCTGCCCTCCTTCGGCCCCGGCGTC<br>ACCAGGCCTGTCCTTGGGTCCAGGGACATCTCGCCCGTCCTGAAGGACCCCGCCTCC<br>TTCCGCGCCGCCATCGGCCTCCTGGCGCGACACCTGAAGGCGACCCACGGGGGCCG<br>CATCGACTACATCGCAGGCGAGTGCCCAGTGGCCGCATCTAGGGCGCTTCCGCCTCT<br>GCGCGCGCCGAGGGCAGCACGTGGGCTCTGCGCGTCTGCTTGGGGGAGGGCCTTT<br>GGGGTGCTTCAGGGGGCGCCGGGACGGGCGCCGTGCTTGGGTCGCCCGGGAAGG<br>GTTGTGAGATTGAGCCC (SEQ ID NO: 201) | |
| pARBI-597:<br>APRT_2_Ex<br>ogenous_2 | TGCCCCGCCCCTCACCCACGCTCCGCCCTCCGGGGATGCCCCACCCCTCGTGGCGGT<br>CCCGCCCGTCCCCGCGCAGGCGCGCTCGGGCTGCCGCTGGCTCTTCGCACGCGGCC<br>ATGGCCGACTCCGAGCTGCAGCTGGTTGAGCAGCGGATCCGCAGCTTCCCCGACTTC<br>CCCACCCCAGGCGTGGTATTCAGGTGCACGCACAGGCCGCCCTCGTGGCGCCCCGA<br>CCTGCGGGCCTACGGATGGGAGCGCGTGGCCCGCGACCTCCGGGCGGGCG<br>GGAACCCTCGTCTTTCGCCCCCGGGGCCCTGCCCTCCTTCGGCCCCGGCGTCACCAG<br>GCCTGTCCTTGGGTCCAGGGACATCTCGCCCGTCCTGAAGGACCCCGCCTCCTTCCG<br>CGCCGCCATCGGCCTCCTGGCGCGACACCTGAAGGCGACCCACGGGGGCCGCATCt<br>gacgactgtgccttctagttgccagccatctgttgtttgcccctcccccgtgccttccttgaccctggaaggtgcc<br>actcccactgtcctttcctaataaaatgaggaaattgcatcgcattgtctgagtaggtgtcattctattctgggg<br>gtggggtggggcaggacagcaagggggaggattgggaagacaatagcaggcatgctggggatgcggtgggc<br>tctatggGGATCTGCGATCGCTCCGGTGCCCGTCAGTGGGCAGAGCGCACATCGCCCA<br>CAGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc | 2541 |

TABLE 5-continued

CONSTRUCTS USED FOR EVALUATION OF PREDICTED LOCI

| Construct name | Sequence | Length |
|---|---|---|
| | attctagttgtggtttgtccaaactcatcaatgtatcttatGACTACATCGCAGGCGAGTGCCCAGTG<br>GCCGCATCTAGGGCGCTTCCGCCTCTGCGCGCGCCGAGGGCAGCACGTGGGCTCTG<br>CGCGTCTGCTTGGGGGAGGGCCTTTGGGGTGCTTCAGGGGGCGCCGGGACGGGCG<br>CCGTGCTTGGGTCGCCCGGGAAGGGTTGTGAGATTGAGCCCCCGAGGCCGCCGCGC<br>TGTGCAGGCGTCCTTCCCGCAGGTTCCGGGTCCCCAGCCCAGGACAGGCGTGACCG<br>AGTTGCCGGGTCAGTTGGTCTCCCTGGAGTGCCCAAGCTGAATCCACAGGGCCCAG<br>CTGCCTTGCTTCTTGTTCCTTCTGCGAGCTGGTATTGAGCGCCTGCCACGAGCCAGG<br>CCTTCCCTGGTGAAGATCACGGAATGCCCACCCAGGGAAGGGAGGCCTGGAGGCCT<br>CCGGGAGAGCCCAAGAGGTGGCCCAGGGAGA (SEQ ID NO: 202) | |
| pARBI-598:<br>APRT_3_Ex<br>ogenous_3 | CGTTCTGctcagtggtgcgtggaatgcgagcgcgtcttaaaatcgatggcgcctaggagtccatgaaatacg<br>gTACAGGCTTCCGGCGACGGATGCCCCGCCCCTCACCCACGCTCCGCCCTCCGGGGA<br>TGCCCCACCCCTCGTGGCGGTCCCGCCCGTCCCCGCGCAGGCGCGCTCGGGCTGCC<br>GCTGGCTCTTCGCACGCGGCCATGGCCGACTCCGAGCTGCAGCTGGTTGAGCAGCG<br>GATCCGCAGCTTCCCCGACTTCCCCACCCCAGGCGTGGTATTCAGGTGCACGCACAG<br>GCCGCCCTCGTGGCGCCCCGACCTGCGGGCCTACGATGGGAGCGCGTGGCCCGC<br>GACCTCCGGGCGGGCGGGGCGGGAACCCTCGTCTTTCGCCCCCGGGGCCCTGCCCT<br>CCTTCGGCCCCGGCGTCACCAGGCCTGTCCTTGGGTCAGGtgacgactgtgccttctagttg<br>ccagccatctgttgtttgcccctcccccgtgccttccttgaccctggaaggtgccactcccactgtcctttcctaat<br>aaaatgaggaaattgcatcgcattgtctgagtaggtgtcattctattctgggggtggggtggggcaggacagc<br>aaggggggaggattgggaagacaatagcaggcatgctggggatgcggtgggctctatggGGATCTGCGAT<br>CGCTCCGGTGCCCGTCAGTGGGCAGAGCGCACATCGCCCACAGTCCCCGAGAAGTT<br>GGGGGGAGGGGTCGGCAATTGAACGGGTGCCTAGAGAAGGTGGCGCGGGGTAAA<br>CTGGGAAAGTGATGTCGTGTACTGGCTCCGCCTTTTTCCCAGGGGTGGGGGAGAAC<br>CGTATATAAGTGCAGTAGTCGCCGTGAACGTTCTTTTTCGCAACGGGTTTGCCGCCA<br>GAACACAGCTGAAGCTTCGAGGGGCTCGCATCTCTCCTTCACGCGCCCGCCGCCCTA<br>CCTGAGGCCGCCATCCACGCCGGTTGAGTCGCGTTCTGCCGCCTCCCGCCTGTGGTG<br>CCTCCTGAACTGCGTCCGCCGTCTAGGTAAGTTTAAAGCTCAGGTCGAGACCGGGCC<br>TTTGTCCGGCGCTCCCTTGGAGCCTACCTAGACTCAGCCGGCTCTCCACGCTTTGCCT<br>GACCCTGCTTGCTCAACTCTACGTCTTTGTTTCGTTTTCTGTTCTGCGCCGTTACAGAT<br>CCAAGCTGTGACCGGCGCCTACTCTAGAGCTAGCGAATTgccgccaccATGGTGAGCA<br>AGGGCGAGGAGCTGTTCACCGGGGTGGTGCCCATCCTGGTCGAGCTGGACGGCGA<br>CGTAAACGGCCACAAGTTCAGCGTGTCCGGCGAGGGCGAGGGCGATGCCACCTAC<br>GGCAAGCTGACCCTGAAGTTCATCTGCACCACCGGCAAGCTGCCCGTGCCCTGGCCC<br>ACCCTCGTGACCACCCTGACCTACGGCGTGCAGTGCTTCAGCCGCTACCCCGACCAC<br>ATGAAGCAGCACGACTTCTTCAAGTCCGCCATGCCCGAAGGCTACGTCCAGGAGCG<br>CACCATCTTCTTCAAGGACGACGGCAACTACAAGACCCGCGCCGAGGTGAAGTTCG<br>AGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATA<br>TCATGGCCGACAAGCAGAAGAACGGCATCAAGGTGAACTTCAAGATCCGCCACAAC<br>ATCGAGGACGGCAGCGTGCAGCTCGCCGACCACTACCAGCAGAACACCCCCATCGG<br>CGACGGCCCCGTGCTGCTGCCCGACAACCACTACCTGAGCACCCAGTCCAAGCTGA<br>GCAAAGACCCCAACGAGAAGCGCGATCACATGGTCCTGCTGGAGTTCGTGACCGCC<br>GCCGGGATCACTCTCGGCATGGACGAGCTGTACAAAtgattgtttattgcagcttataatggtt<br>acaaataaagcaatagcatcacaaatttcacaaataaagcatttttttcactgcattctagttgtggtttgtccaa<br>actcatcaatgtatcttatGACATCTCGCCCGTCCTGAAGGACCCCGCCTCCTTCCGCGCCG<br>CCATCGGCCTCCTGGCGCGACACCTGAAGGCGACCCACGGGGGCCGCATCGACTAC<br>ATCGCAGGCGAGTGCCCAGTGGCCGCATCTAGGGCGCTTCCGCCTCTGCGCGCGCC<br>GAGGGCAGCACGTGGGCTCTGCGCGTCTGCTTGGGGGAGGGCCTTTGGGGTGCTT<br>CAGGGGGGCGCCGGGACGGGCGCCGTGCTTGGGTCGCCCGGGAAGGGTTGTGAGAT<br>TGAGCCCCCGAGGCCGCCGCGCTGTGCAGGCGTCCTTCCCGCAGGTTCCGGGTCCC<br>CAGCCCAGGACAGGCGTGACCGAGTTGCCGGGTCAGTTGGTCTCCCTGGAGTGCCC<br>AAGCTGAATCCACAGGGCCCAGCTGCCTTGCTTCTTGTTCCTTCTGCGAGCTGGTATT<br>GAGCGCCTGCCACGA (SEQ ID NO: 203) | 2541 |
| pARBI-599:<br>B2M_1_Exo<br>genous_4 | AGTAATTTGATGGGGGCTATTATGAACTGAGAAATGAACTTTGAAAAGTATCTTGG<br>GGCCAAATCATGTAGACTCTTGAGTGATGTGTTAAGGAATGCTATGAGTGCTGAGA<br>GGGCATCAGAAGTTCCTTGAGAGCCTTCCAGAGAAAGGCTCTTAAAAATGCAGCGCAA<br>TCTCCAGTGACAGAAGATACTGCTAGAAATCTGCTAGAAAAAAAACAAAAAAAGGCA<br>TGTATAGAGGAATTATGAGGGAAAGATACCAAGTCACGGTTTATTCTTCAAAATGG<br>AAGGTGGCTTGTTGGGAAGGTGGAAGCTCATTTGGCCAGAGTGGAAATGGAATTGG<br>GAGAAATCGATGACAAATGTAAACACTTGGTGCCTGATATAGCTTGACACCAAGTT<br>AGCCCCAAGTGAAATACCCTGGCAATATTAATGTGTCTTTTCCCGATATTCCTCAGGT<br>tgacgactgtgccttctagttgccagccatctgttgtttgcccctcccccgtgccttccttgaccctggaaggtgcc<br>actcccactgtcctttcctaataaaatgaggaaattgcatcgcattgtctgagtaggtgtcattctattctggggg<br>gtggggtggggcaggacagcaagggggaggattgggaagacaatagcaggcatgctggggatgcggtgggc<br>tctatggGGATCTGCGATCGCTCCGGTGCCCGTCAGTGGGCAGAGCGCACATCGCCCA<br>CAGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG | 2541 |

TABLE 5-continued

CONSTRUCTS USED FOR EVALUATION OF PREDICTED LOCI

| Construct name | Sequence | Length |
|---|---|---|
| | TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcattttttcactgc<br>attctagttgtggtttgtccaaactcatcaatgtatcttatACTCCAAAGATTCAGGTTTACTCACGTC<br>ATCCAGCAGAGAATGGAAAGTCAAATTTCCTGAATTGCTATGTGTCTGGGTTTCATC<br>CATCCGACATTGAAGTTGACTTACTGAAGAATGGAGAGAGAATTGAAAAAGTGGAG<br>CATTCAGACTTGTCTTTCAGCAAGGACTGGTCTTTCTATCTCTTGTACTACACTGAATT<br>CACCCCCACTGAAAAAGATGAGTATGCCTGCCGTGTGAACCATGTGACTTTGTCACA<br>GCCCAAGATAGTTAAGTGGGGTAAGTCTTACATTCTTTTGTAAGCTGCTGAAAGTTG<br>TGTATGAGTAGTCATATCATAAAGCTGCTTTGATATAAAAAAGGTCTATGGCCATAC<br>TACCCTGAATGAGTCCCATCCCATCTGATATAAACAATCTGCATATTGGGATTGTCAG<br>GGAATGTTCTTAAAGATCAGA (SEQ ID NO: 204) | |
| pARB1-600:<br>B2M_2_Exo<br>genous_5 | AAGATCTTAATCTTCTGGGTTTCCGTTTTCTCGAATGAAAAATGCAGGTCCGAGCAG<br>TTAACTGGCTGGGGCACCATTAGCAAGTCACTTAGCATCTCTGGGGCCAGTCTGCAA<br>AGCGAGGGGGCAGCCTTAATGTGCCTCCAGCCTGAAGTCTAGAACTGCCCGCGG<br>TGTCCCAAGCTGGGGCGCGCACCCCAGATCGGAGGGCGCCGATGTACAGACAGCA<br>AACTCACCCAGTCTAGTGCATGCCTTCTTAAACATCACGAGACTCTAAGAAAAGGAA<br>ACTGAAAACGGGAAAGTCCCTCTCTCTAACCTGGCACTGCGTCGCTGGCTTGGAGAC<br>AGGTGACGGTCCCTGCGGGCCTTGTCCTGATTGGCTGGGCACGCGTTTAATATAAGT<br>GGAGGCGTCGCGCTGGCGGGCATTCCTGAAGCTGACAGCATTCGGGCCGAGATGt<br>acgactgtgcctctagttgccagccatctgttgtttgcccctcccccgtgccttccttgaccctggaaggtgccac<br>tcccactgtcctttcctaataaaatgaggaaattgcatcgcattgtctgagtaggtgtcattctattctgggggt<br>ggggtggggcaggacagcaaggggaggattgggaagacaatagcaggcatgctgggatgcggtgggctc<br>tatggGATCTGCGATCGCTCCGGTGCCCGTCAGTGGGCAGAGCGCACATCGCCCAC<br>AGTCCCCGAGAAGTTGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcattttttcactgc<br>attctagttgtggtttgtccaaactcatcaatgtatcttatTCTCGCTCCGTGGCCTTAGCTGTGCTCG<br>CGCTACTCTCTTTCTGGCCTGGAGGCTATCCAGCGTGAGTCTCTCCTACCCTCCCG<br>CTCTGGTCCTTCCTCTCCCGCTCTGCACCCTCTGTGGCCCTCGCTGTGCTCTCTCGCTC<br>CGTGACTTCCCTTCTCCAAGTTCTCCTTGGTGCCCGCCGTGGGGCTAGTCCAGGGC<br>TGGATCTCGGGGAAGCGGCGGGTGGCCTGGGAGTGGGAAGGGGGTGCGCACC<br>CGGGACGCGCGCTACTTGCCCCTTTCGGCGGGGAGCAGGGGAGACCTTTGGCCTAC<br>GGCGACGGGAGGGTCGGGACAAAGTTTAGGGCGTCGATAAGCGTCAGAGCGCCGA<br>GGTTGGGGAGGGTTTCTTCCGCTCTTTCGCGGGGCCTCTGGCTCCCCAGCGCA<br>GCTGGAGTGGGGGACGGGTAGGCTCG (SEQ ID NO: 205) | 2541 |
| pARBI-601:<br>B2M_3_Exo<br>genous_6 | AGGAATGCTATGAGTGCTGAGAGGGCATCAGAAGTCCTTGAGAGCCTCCAGAGAAA<br>GGCTCTTAAAAATGCAGCGCAATCTCCAGTGACAGAAGATACTGCTAGAAATCTGCT<br>AGAAAAAAAACAAAAAAGGCATGTATAGAGGAATTATGAGGGAAAGATACCAAGT<br>CACGGTTTATTCTTCAAAATGGAGGTGGCTTGTTGGGAAGGTGGAAGCTCATTTGGC<br>CAGAGTGGAAATGGAATTGGGAGAAATCGATGACCAAATGTAAACACTTGGTGCCT | 2541 |

TABLE 5-continued

CONSTRUCTS USED FOR EVALUATION OF PREDICTED LOCI

| Construct name | Sequence | Length |
|---|---|---|
| | GATATAGCTTGACACCAAGTTAGCCCCAAGTGAAATACCCTGGCAATATTAATGTGT<br>CTTTTCCCGATATTCCTCAGGTACTCCAAAGATTCAGGTTTACTCACGTCATCCAGCA<br>GAGAATGGAAAGTCAAATTTCCTGAATTGCTATGTGTCTGGGTTTCATCCATCCtgacg<br>actgtgccttctagttgccagccatctgttgtttgccccctccccgtgccttccttgaccctggaaggtgccactcc<br>cactgtcctttcctaataaaatgaggaaattgcatcgcattgtctgagtaggtgtcattctattctgggggtggg<br>gtggggcaggacagcaaggggaggattgggaagacaatagcaggcatgctggggatgcggtgggctctat<br>ggGGATCTGCGATCGCTCCGGTGCCCGTCAGTGGGCAGAGCGCACATCGCCCACAG<br>TCCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcattttttttcactgcattctag<br>ttgtggtttgtccaaactcatcaatgtatcttatGACATTGAAGTTGACTTACTGAAGAATGGAGA<br>GAGAATTGAAAAAGTGGAGCATTCAGACTTGTCTTTCAGCAAGGACTGGTCTTTCTA<br>TCTCTTGTACTACACTGAATTCACCCCCACTGAAAAAGATGAGTATGCCTGCCGTGTG<br>AACCATGTGACTTTGTCACAGCCCAAGATAGTTAAGTGGGGTAAGTCTTACATTCTTT<br>TGTAAGCTGCTGAAAGTTGTGTATGAGTAGTCATATCATAAAGCTGCTTTGATATAA<br>AAAAGGTCTATGGCCATACTACCCTGAATGAGTCCCATCCCATCTGATATAAACAATC<br>TGCATATTGGGATTGTCAGGGAATGTTCTTAAAGATCAGATTAGTGGCACCTGCTGA<br>GATACTGATGCAACAGCATGGTTTCTGAACCAGTAGTTTCCCTGCAGTTGAGCAGGGA<br>GCAGCAGCAGCACTTG (SEQ ID NO: 206) | |
| pARBI-602:<br>CAPNS1_1_<br>Exogenous_<br>7 | GATCTCACATTCTAGCGCCCAGACATGTCGGGAACGCCTTACGCCAACTTGGGGTCC<br>CCACCAAGAGAACCCCCACCAGATCTGCACCCTCCCCTTCACGCGTGCACCCAGTCC<br>AGGCTCCCTCAAGCCCCACGGGTGCCTTTTAGACCTGAGGAGGTTGCAAACCTGATC<br>CCCCATACCTGCCCCACCCATCCGCGGACAACCCGCCCTCGCAAACTCAGACCCCCAC<br>CCGGAGGCTTCAGATTCCTCCCAGGTCCAGCTGCCGGAAATGCGTGTTGAAGGGA<br>GGGTGTGGGCTCAGGGGCGAAGCACCCACTGGTCCCCTTTTTTCCCCCCAGCAGTGA<br>GTCGCAGCCATGTTCCTGGTTAACTCGTTCTTGAAGGGCGGCGGCGGCGGCGGCGG<br>GGGAGGCGGGGGCCTGGGTGGGGGCCTGGGAAATGTGCTTGGAGGCCTGATCtga<br>cgactgtgccttctagttgccagccatctgttgtttgccccctccccgtgccttccttgaccctggaaggtgccact<br>cccactgtcctttcctaataaaatgaggaaattgcatcgcattgtctgagtaggtgtcattctattctgggggtg<br>gggtggggcaggacagcaaggggaggattgggaagacaatagcaggcatgctggggatgcggtgggctct<br>atggGGATCTGCGATCGCTCCGGTGCCCGTCAGTGGGCAGAGCGCACATCGCCCACA<br>GTCCCCGAGAAGTTGGGGGGAGGGGTCGGCAATTGAACGGGTGCCTAGAGAAGGT<br>GGCGCGGGGTAAACTGGGAAAGTGATGTCGTGTACTGGCTCCGCCTTTTTCCCGAG<br>GGTGGGGGAGAACCGTATATAAGTGCAGTAGTCGCCGTGAACGTTCTTTTTCGCAA<br>CGGGTTTGCCGCCAGAACACAGCTGAAGCTTCGAGGGGCTCGCATCTCTCCTTCACG<br>CGCCCGCCGCCCTACCTGAGGCCGCCATCCACGCCGGTTGAGTCGCGTTCTGCCGCC<br>TCCCGCCTGTGGTGCCTCCTGAACTGCGTCCGCCGTCTAGGTAAGTTTAAAGCTCAG<br>GTCGAGACCGGGCCTTTGTCCGGCGCTCCCTTGGAGCCTACCTAGACTCAGCCGGCT<br>CTCCACGCTTTGCCTGACCCTGCTTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcattttttttcactgcattctag | 2541 |

TABLE 5-continued

CONSTRUCTS USED FOR EVALUATION OF PREDICTED LOCI

| Construct name | Sequence | Length |
|---|---|---|
| | ttgtggtttgtccaaactcatcaatgtatcttatAGCGGGGCCGGGGCGGCGGCGGCGGCGGC<br>GGCGGCGGCGGTGGTGGAGGCGGCGGTGGCGGTGGAACGGCCATGCGCATC<br>CTAGGCGGAGTCATCAGCGCCATCAGGTAAGGCGGAGACTATCAGAGGGGCGGGG<br>CCTGGGAATGGGAGGAGCCTCAGTGAGGCGTGGTCTGGGAGGGGCGTGGTCTAAA<br>AATAGAATAGGATTAACCTGGAGGCTAACCTGGGTACATGAATTAGGCCGGGGAG<br>GCCTGGTTTGAGAGTTCTGCTGTAAGGGGGTGGACCCCAGTGAGGCGGATATCAGT<br>CATTGGGGCGGTGCTTGATATGGGAGTAGTCTGATTGTGTGGGACCAGGACAATG<br>TGGTCCTGAGGGGACTGATGTGGAGTTTTTGGCGGGTGGGGCTTATGGGTCTGGGCT<br>CAGCCTGCATTGGCTAACCTGGAGATGAACGTT (SEQ ID NO: 207) | |
| pARBI-603:<br>CAPNS1_2_<br>Exogenous_<br>8 | CGGGCATTTAGGAAGCGGGCCATGGAGTAGGGTCTTGGGCAGATGGCCACCTGAGG<br>AGGATAAGGCCTTGGGAAGCTGGGGCAGAGCCTCTATGAAGTGAGCCCTCCAAGG<br>GGCGGGGTCTTTTGATTCTACGTGGGATTTTTTAGGTTTAGGGTGGCCAAGATGACT<br>GAAATCTGCCACTGGGTAGGTGTGCCTGGCAGGAGGGGAGCCTCCCAGGGGACCG<br>GTCTCTGGGTTTCCTCGAGGGTGGGGTTGGCCTGAGGAAGGGAGAAGAGGGGCAC<br>GACCAGGGCAGTGTGGATTGGGACAGATGAGGACAAGAACAAATGAAAGGCACAG<br>CAACCAAGTAAGGAAGATAACGGCTGGGGTCTGGAGCGTTGGGGCTGATGGTTCT<br>GTAGTGCTGCCCGTTGGAGGCCCCGCCCCTGGCACTAACCCCTCCCCCTTATCTCTTC<br>GCAGCtgacgactgtgccttctagttgccagccatctgttgtttgcccctcccccgtgccttccttgaccctgga<br>aggtgccactcccactgtcctttcctaataaaatgaggaaattgcatcgcattgtctgagtaggtgtcattctatt<br>ctgggggtgggggtggggcaggacagcaaggggaggattgggaagacaatagcaggcatgctggggatgc<br>ggtgggctctatggGGACTCGCGATCGCTCCGGTGCCCGTCAGTGGGCAGAGCGCACAT<br>CGCCCACAGTCCCCGAGAAGTTGGGGGGAGGGGTCGGCAATTGAACGGGTGCCTA<br>GAGAAGGTGGCGCGGGGTAAACTGGGAAAGTGATGTCGTGTACTGGCTCCGCCTTT<br>TTCCCGAGGGTGGGGGAGAACCGTATATAAGTGCAGTAGTCGCCGTGAACGTTCTT<br>TTTCGCAACGGGTTTGCCGCCAGAACACAGCTGAAGCTTCGAGGGGCTCGCATCTCT<br>CCTTCACGCGCCCGCCGCCCTACCTGAGGCCGCCATCCACGCCGGTTGAGTCGCGTT<br>CTGCCGCCTCCCGCCTGTGGTGCCTCCTGAACTGCGTCCGCCGTCTAGGTAAGTTTA<br>AAGCTCAGGTCGAGACCGGGCCTTTGTCCGGCGCTCCCTTGGAGCCTACCTAGACTC<br>AGCCGGCTCTCCACGCTTTGCCTGACCCTGCTTGCTCAACTCTACGTCTTTGTTTCGTT<br>TTCTGTTCTGCGCCGTTACAGATCCAAGCTGTGACCGGCGCCTACTCTAGAGCTAGC<br>GAATTgccgccaccATGGTGAGCAAGGGCGAGGAGCTGTTCACCGGGGTGGTGCCCA<br>TCCTGGTCGAGCTGGACGGCGACGTAAACGGCCACAAGTTCAGCGTGTCCGGCGAG<br>GGCGAGGGCGATGCCACCTACGGCAAGCTGACCCTGAAGTTCATCTGCACCACCGG<br>CAAGCTGCCCGTGCCCTGGCCCACCCTCGTGACCACCCTGACCTACGGCGTGCAGTG<br>CTTCAGCCGCTACCCCGACCACATGAAGCAGCACGACTTCTTCAAGTCCGCCATGCC<br>CGAAGGCTACGTCCAGGAGCGCACCATCTTCTTCAAGGACGACGGCAACTACAAGA<br>CCCGCGCCGAGGTGAAGTTCGAGGGCGACACCCTGGTGAACCGCATCGAGCTGAA<br>GGGCATCGACTTCAAGGAGGACGGCAACATCCTGGGGCACAAGCTGGAGTACAAC<br>TACAACAGCCACAACGTCTATATCATGGCCGACAAGCAGAAGAACGGCATCAAGGT<br>GAACTTCAAGATCCGCCACAACATCGAGGACGGCAGCGTGCAGCTCGCCGACCACT<br>ACCAGCAGAACACCCCCATCGGCGACGGCCCCGTGCTGCTGCCCGACAACCACTACC<br>TGAGCACCCAGTCCAAGCTGAGCAAAGACCCCAACGAGAAGCGCGATCACATGGTC<br>CTGCTGGAGTTCGTGACCGCCGCCGGGATCACTCTCGGCATGGACGAGCTGTACAA<br>atgattgtttattgcagcttataatggttacaaataaagcatcatcacaaatttcacaaataaagcatttttt<br>tcactgcattctagttgtggtttgtccaaactcatcaatgtatcttatGAGGCGGCTGCGCAGTACAAC<br>CCGGAGCCCCCGGTAAGCCCCTCTGCAACCAGACCCCCTTCTCCTGCCAAGGCCTC<br>TTCGAGGTCCCATCCCTGTTCCTGTAGAGAAGCCCCACCTTCCTCCCCTTCTTGTGAA<br>ATTCCTCTGCCAGTTCCTCCCATGCCGTGTCTGCAGCTTCGCCATGGGTCTTAGCCAT<br>GCCCCACATACGTGCACCCCATTCACTACCACCCCTCATTCTTTTCCTCATCAAGCTGC<br>CCAGCCCACTCTGACTTCCCCACCCAGGGTACCTGGGTTTGGGGAGCCGTCCTGGCC<br>GGGTTCCCCTCCCCCTGCTCTGAGCTCTCCTCCCTTTGCAGCCCCCACGCACACATTA<br>CTCAACATTGAGGCCAACGAGAGTGAGGAGGTCCGGCAGTTCCGGAGACTCTTTG<br>(SEQ ID NO: 208) | 2541 |
| pARBI-604:<br>CAPN51_3_<br>Exogenous_<br>9 | GCTGATGGTTCTGTAGTGCTGCCCGTTGGAGGCCCCGCCCCTGGCACTAACCCCTCC<br>CCCTTATCTCTTCGCAGCGAGGCGGCTGCGCAGTACAACCCGGAGCCCCGGTAAG<br>CCCCCTCTGCAACCAGACCCCCTTCTCCTGCCAAGGCCTCTTCGAGGTCCCATCCCTG<br>TTCCTGTAGAGAAGCCCCACCTTCCTCCCCTTCTTGTGAAATTCCTCTGCCAGTTCCTC<br>CCATGCCGTGTCTGCAGCTTCGCCATGGGTCTTAGCCATGCCCCACATACGTGCACC<br>CCATTCACTACCACCCCTCATTCTMCCTCATCAAGCTGCCCAGCCCACTCTGACTTC<br>CCCACCCAGGGTACCTGGGTTTGGGGAGCCGTCCTGGCCGGGTTCCCCTCCCCCTGC<br>TCTGAGCTCTCCTCCCTTTGCAGCCCCCACGCACACATTACTCCAACtgacgactgtgccttc<br>tagttgccagccatctgttgtttgcccctcccccgtgccttccttgaccctggaaggtgccactcccactgtcctt<br>tcctaataaaatgaggaaattgcatcgcattgtctgagtaggtgtcattctattctgggggtgggggtggggca<br>ggacagcaaggggaggattgggaagacaatagcaggcatgctgggatgcggtgggctctatggGGATC<br>TGCGATCGCTCCGGTGCCCGTCAGTGGGCAGAGCGCACATCGCCCACAGTCCCCGA<br>GAAGTTGGGGGGAGGGGTCGGCAATTGAACGGGTGCCTAGAGAAGGTGGCGCGG<br>GGTAAACTGGGAAAGTGATGTCGTGTACTGGCTCCGCCTTMCCCGAGGGTGGGG<br>GAGAACCGTATATAAGTGCAGTAGTCGCCGTGAACGTTCTTTTTCGCAACGGGTTTG<br>CCGCCAGAACACAGCTGAAGCTTCGAGGGGCTCGCATCTCTCCTTCACGCGCCCGCC<br>GCCCTACCTGAGGCCGCCATCCACGCCGGTTGAGTCGCGTTCTGCCGCCTCCCGCCT<br>GTGGTGCCTCCTGAACTGCGTCCGCCGTCTAGGTAAGTTTAAAGCTCAGGTCGAGAC<br>CGGGCCTTTGTCCGGCGCTCCCTTGGAGCCTACCTAGACTCAGCCGGCTCTCCACGC<br>TTTGCCTGACCCTGCTTGCTCAACTCTACGTCTTTGTTTCGTTTTCTGTTCTGCGCCGT | 2541 |

TABLE 5-continued

CONSTRUCTS USED FOR EVALUATION OF PREDICTED LOCI

| Construct name | Sequence | Length |
|---|---|---|
| | TACAGATCCAAGCTGTGACCGGCGCCTACTCTAGAGCTAGCGAATTgccgccaccATGG<br>TGAGCAAGGGCGAGGAGCTGTTCACCGGGGTGGTGCCCATCCTGGTCGAGCTGGA<br>CGGCGACGTAAACGGCCACAAGTTCAGCGTGTCCGGCGAGGGCGAGGGCGATGCC<br>ACCTACGGCAAGCTGACCCTGAAGTTCATCTGCACCACCGGCAAGCTGCCCGTGCCC<br>TGGCCCACCCTCGTGACCACCCTGACCTACGGCGTGCAGTGCTTCAGCCGCTACCCC<br>GACCACATGAAGCAGCACGACTTCTTCAAGTCCGCCATGCCCGAAGGCTACGTCCAG<br>GAGCGCACCATCTTCTTCAAGGACGACGGCAACTACAAGACCCGCGCCGAGGTGAA<br>GTTCGAGGGCGACACCCTGGTGAACCGCATCGAGCTGAAGGGCATCGACTTCAAGG<br>AGGACGGCAACATCCTGGGGCACAAGCTGGAGTACAACTACAACAGCCACAACGTC<br>TATATCATGGCCGACAAGCAGAAGAACGGCATCAAGGTGAACTTCAAGATCCGCCA<br>CAACATCGAGGACGGCAGCGTGCAGCTCGCCGACCACTACCAGCAGAACACCCCCA<br>TCGGCGACGGCCCCGTGCTGCTGCCCGACAACCACTACCTGAGCACCCAGTCCAAGC<br>TGAGCAAAGACCCCAACGAGAAGCGCGATCACATGGTCCTGCTGGAGTTCGTGACC<br>GCCGCCGGGATCACTCTCGGCATGGACGAGCTGTACAAatgattgtttattgcagcttataat<br>ggttacaaataaagcaatagcatcacaaatttcacaaataaagcatttttttcactgcattctagttgtggtttgt<br>ccaaactcatcaatgtatcttatATTGAGGCCAACGAGAGTGAGGAGGTCCGGCAGTTCCG<br>GAGACTCTTTGCCCAGCTGGCTGGAGATGTAAGTAACCTGGGGTCCCTGGCCCCGTC<br>CTAACCGTTCCATCCCTTCCCTTGTGGCTGCCCTTGCACACACACCCTTGACCATGAC<br>AATCCCAGTGTTCCCATTCTCCATGACATTCTCAGACCCCTTTCAGTCACCCCTGACCT<br>GCCCCTAACTTCCGCCCGCAGGACATGGAGGTCAGCGCCACAGAACTCATGAACATT<br>CTCAATAAGGTTGTGACACGACGTAAGTGACCGGGGTTAAGGAATAGGGTAGATTC<br>AGAGGCAGAGGGGTCAGAGAGGATTTGACCTCTGGCCTCTGACTTTCAACCTGTTA<br>CCCACAGACCCTGATCTGAAGACTGATGGTTTTGGCATTGACACATGTCGCAGCATG<br>GTGGCCGTGATG (SEQ ID NO: 209) | |
| pARBI-605:<br>CBLB_1_Ex<br>ogenous_1<br>0 | ggagagttatagcagatggagacaaaaaagggaactgctggggatcaaaccttgtaaagtccttctaagtgat<br>atatgaggactttgacttttattcaaagttagaaggctttgaacaaaagaattatttcatttgtgttttacaatggt<br>cacaagtgccgtagcgagaataggctgTGTAGAGAAGAGATTTTGTGGTTTTCTTTTTTGTTCT<br>CTGTATTCTCTTCCTGAAAAATCTGTTTTCTGCCTAATCATATTTCTGTAAAGAACAAT<br>AGACTTGAACGTCTGCTGTTAAGTAACAAAGGTTGACCTAAACCACATAAGGTCAGA<br>TTAACTTTTAAAATATCCAAGATAATGTTAAGTGTATTAAATATGGTTCAGTATGTAA<br>TCAAAATATTTGATATTCTCTAGATACTAATCTCttttaattttttattttttAGCCTTGGtgac<br>gactgtgccttctagttgccagccatctgttgtttgccctccccccgtgccttccttgaccctggaaggtgccactc<br>ccactgtcctttcctaataaaatgaggaaattgcatcgcattgtctgagtaggtgtcattctattctgggggtgg<br>ggtggggcaggacagcaaggggggaggattgggaagacaatagcaggcatgctggggatgcggtgggctcta<br>tggGGATCTGCGATCGCTCCGGTGCCCGTCAGTGGGCAGAGCGCACATCGCCCACAG<br>TCCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcatttttttcactgcattctag<br>ttgtggtttgtccaaactcatcaatgtatcttatGGCTCTATTTTGCGGAATTGGAATTTCTTAGCT<br>GTGACACATCCAGGTTACATGGCATTTCTCACATATGATGAAGTTAAAGCACGACTA<br>CAGAAATATAGCACCAAACCCGGAAGGTAAGACTTTTTAGCAGTAATAATTATGTGAT<br>ATATCCAAAGATGAAAAATTCTCCATGGTTTGTTCCTAAGTAAGTCAGCAATACCCG<br>CTGATGGCATGCTTGGGAGGGGGCTAGAAAAGGTAAAAGACCAAAATGGTGCTTCT<br>TAACATAATGTTTTAAATTGATACATTGTGCTTACTCTGAAACTTGGTATTCATAAAG<br>TGAAAGGGGATATGGTCTCCTTTCTGTTTTCATGATATCCGTGTTTATGTGCAAAATT<br>GAATGTATATATTTGAATACTTGAATACTGTGCTAAAGAACAAATAAATAGAACAGT<br>CTTATGTTCATTACTTT (SEQ ID NO: 210) | 2541 |
| pARB1-606:<br>CBLB_2_Ex<br>ogenous_1<br>1 | CATATTACTCATTTGTGCAATGAATAAAGGATTTCTATTATTATATGGACCCCATCATCT<br>TATGACTGTTTTTAGAAAATGAGAATTAAATCTTGATTCATTATTAAATAACCTTGTA<br>TACACACATGAAGAGGTCATGACACATAAGACTTTGACCTAATACCTTTTTTCAGATA<br>TGTTTCTATAGCTATCTTGATAGCCTAGGACTGTTTGAGAGAAAATTAATTTAAATTT<br>TTGTCATATTCTTAGCAAATGCAAATAATTGAGTTAAACAGAACCCACTACATTTGT<br>TCTGAAATATGAACAATATTCTCAAATATTTGTCTGGTAGTACAAATACAATTATATT | 2541 |

TABLE 5-continued

CONSTRUCTS USED FOR EVALUATION OF PREDICTED LOCI

| Construct name | Sequence | Length |
|---|---|---|
| | AATTTTATTATTGAATTTTGCTGCTTCAAAGGGAGGTATTTCTTAAATGATACTTGATT<br>CAATTATTTCCCTTTTTTTCCACCTTGCACAGAACTATCGTAtgacgactgtgccttctagttgc<br>cagccatctgttgtttgccctccccgtgccttccttgaccctggaaggtgccactcccactgtcctttcctaata<br>aatgaggaaattgcatcgcattgtctgagtaggtgtcattctattctggggggtggggtggggcaggacagca<br>aggggaggattgggaagacaatagcaggcatgctggggatgcggtgggctctatgGGATCTGCGAT<br>CGCTCCGGTGCCCGTCAGTGGGCAGAGCGCACATCGCCCACAGTCCCCGAGAAGTT<br>GGGGGGAGGGGTCGGCAATTGAACGGGTGCCTAGAGAAGGTGGCGCGGGGTAAA<br>CTGGGAAAGTGATGTCGTGTACTGGCTCCGCCTTTTTCCCGAGGGTGGGGGAGAAC<br>CGTATATAAGTGCAGTAGTCGCCGTGAACGTTCTTTTTCGCAACGGGTTTGCCGCCA<br>GAACACAGCTGAAGCTTCGAGGGGCTCGCATCTCTCCTTCACGCGCCCGCCGCCCTA<br>CCTGAGGCCGCCATCCACGCCGGTTGAGTCGCGTTCTGCCGCCTCCCGCCTGTGGTG<br>CCTCCTGAACTGCGTCCGCCGTCTAGGTAAGTTTAAAGCTCAGGTCGAGACCGGGCC<br>TTTGTCCGGCGCTCCCTTGGAGCCTACCTAGACTCAGCCGGCTCTCCACGCTTTGCCT<br>GACCCTGCTGCTCAACTCTACGTCTTTGTTTCGTTTTCTGTTCTGCGCCGTTACAGAT<br>CCAAGCTGTGACCGGCGCCTACTCTAGAGCTAGCGAATTgccgccaccATGGTGAGCA<br>AGGGCGAGGAGCTGTTCACCGGGGTGGTGCCCATCCTGGTCGAGCTGGACGGCGA<br>CGTAAACGGCCACAAGTTCAGCGTGTCCGGCGAGGGCGAGGGCGATGCCACCTAC<br>GGCAAGCTGACCCTGAAGTTCATCTGCACCACCGGCAAGCTGCCCGTGCCCTGGCCC<br>ACCCTCGTGACCACCCTGACCTACGGCGTGCAGTGCTTCAGCCGCTACCCCGACCAC<br>ATGAAGCAGCACGACTTCTTCAAGTCCGCCATGCCCGAAGGCTACGTCCAGGAGCG<br>CACCATCTTCTTCAAGGACGACGGCAACTACAAGACCCGCGCCGAGGTGAAGTTCG<br>AGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATA<br>TCATGGCCGACAAGCAGAAGAACGGCATCAAGGTGAACTTCAAGATCCGCCACAAC<br>ATCGAGGACGGCAGCGTGCAGCTCGCCGACCACTACCAGCAGAACACCCCCATCGG<br>CGACGGCCCCGTGCTGCTGCCCGACAACCACTACCTGAGCACCCAGTCCAAGCTGA<br>GCAAAGACCCCAACGAGAAGCGCGATCACATGGTCCTGCTGGAGTTCGTGACCGCC<br>GCCGGGATCACTCTCGGCATGGACGAGCTGTACAAatgattgtttattgcagcttataatggtt<br>acaaataaagcaatagcatcacaaatttcacaaataaagcattttttcactgcattctagttgtggtttgtccaa<br>actcatcaatgtatcttatCCATGGAAAGTATTCAGACAGTGCCTCATGAGGTCCACCAGA<br>TTAGCTCTGGCCTGGAAGCAATGGCTCTAAATCAACAATTGATTTAACTTGCAATG<br>ATTACATTTCAGMTTGAATTTGATATTTTTACCAGGCTGTTTCAGGTAAGTTTATAC<br>TTGCTTAGTCTATCCATTCCTTcttctctctccctgtctttctctctgtttctctctctctgtctctctct<br>cacacacacacacaTAAACAAACATATGGAAAATAGTGTCATTCCTATTAGTCTGTAATT<br>TTATTGGTATGTTTGGTCATTGTTAAAAGTTTAGAGTGAGCCATTTGGCTTAAGTTTG<br>GAGTTATCAGATGCTGTGAGCCTGGTGGCTGCTTGTTAGCTTTGAGAGGATCCATCC<br>AAAAGAGCTTTGTTTTAAACTCTCTACTTAGTTTCTTACTT (SEQ ID NO: 211) | |
| pARBI-607:<br>CBLB_3_Ex<br>ogenous_1<br>2 | TTAAACTTTAGAGGTTCAAAATAAGGATATGATATAGAAAAGATTGAATGGTAGGA<br>GAACAGAATAGGGATTTATTTATATTATGACAAACGTGACTATCAGTTAATAAATTGG<br>AGATAGTAAGTTAAGATCATTATTTATATATGGAAAAATGAAGAAATAGGACATGG<br>TTCTCTAACTTTTTAATTTTTCTGTGAAATAAAATATTATGACTTATTTTATTTTATCT<br>TTGTTTTTAGGTAAGACTGTGCCAAAATCCCAAACTTCAGTTGAAAAATAGCCCACC<br>ATATATACTTGATATTTTGCCTGATACATATCAGCATTTACGACTTATATTGAGTAAAT<br>ATGATGACAACCAGAAACTTGCCCAACTCAGTGAGAATGAGTACTTTAAAATCTACA<br>TTGATAGCCTTATGAAAAAGTCAAAACGGGCAATAAGACTCTTTAAAtgacgactgtgcc<br>ttctagtttgccagccatctgttgtttgcccctccccgtgccttccttgaccctggaaggtgccactcccactgtcc<br>tttcctaataaaatgaggaaattgcatcgcattgtctgagtaggtgtcattctattctgggggtggggtgggc<br>aggacagcaaggggaggattgggaagacaatagcaggcatgctggggatgcggtgggctctatgGGAT<br>CTGCGATCGCTCCGGTGCCCGTCAGTGGGCAGAGCGCACATCGCCCACAGTCCCCG<br>AGAAGTTGGGGGGAGGGGTCGGCAATTGAACGGGTGCCTAGAGAAGGTGGCGCG<br>GGGTAAACTGGGAAAGTGATGTCGTGTACTGGCTCCGCCTTTTTCCCGAGGGTGGG<br>GGAGAACCGTATATAAGTGCAGTAGTCGCCGTGAACGTTCTTTTTCGCAACGGGTTT<br>GCCGCCAGAACACAGCTGAAGCTTCGAGGGGCTCGCATCTCTCCTTCACGCGCCCGC<br>CGCCCTACCTGAGGCCGCCATCCACGCCGGTTGAGTCGCGTTCTGCCGCCTCCCGCC<br>TGTGGTGCCTCCTGAACTGCGTCCGCCGTCTAGGTAAGTTTAAAGCTCAGGTCGAGA<br>CCGGGCCTTTGTCCGGCGCTCCCTTGGAGCCTACCTAGACTCAGCCGGCTCTCCACG<br>CTTTGCCTGACCCTGCTGCTCAACTCTACGTCTTTGTTTCGTTTTCTGTTCTGCGCCG<br>TTACAGATCCAAGCTGTGACCGGCGCCTACTCTAGAGCTAGCGAATTgccgccaccATG<br>GTGAGCAAGGGCGAGGAGCTGTTCACCGGGGTGGTGCCCATCCTGGTCGAGCTGG<br>ACGGCGACGTAAACGGCCACAAGTTCAGCGTGTCCGGCGAGGGCGAGGGCGATGC<br>CACCTACGGCAAGCTGACCCTGAAGTTCATCTGCACCACCGGCAAGCTGCCCGTGCC<br>CTGGCCCACCCTCGTGACCACCCTGACCTACGGCGTGCAGTGCTTCAGCCGCTACCC<br>CGACCACATGAAGCAGCACGACTTCTTCAAGTCCGCCATGCCCGAAGGCTACGTCCA<br>GGAGCGCACCATCTTCTTCAAGGACGACGGCAACTACAAGACCCGCGCCGAGGTGA<br>AGTTCGAGGGCGACACCCTGGTGAACCGCATCGAGCTGAAGGGCATCGACTTCAAG<br>GAGGACGGCAACATCCTGGGGCACAAGCTGGAGTACAACTACAACAGCCACAACGT<br>CTATATCATGGCCGACAAGCAGAAGAACGGCATCAAGGTGAACTTCAAGATCCGCC<br>ACAACATCGAGGACGGCAGCGTGCAGCTCGCCGACCACTACCAGCAGAACACCCCC<br>ATCGGCGACGGCCCCGTGCTGCTGCCCGACAACCACTACCTGAGCACCCAGTCCAA<br>GCTGAGCAAAGACCCCAACGAGAAGCGCGATCACATGGTCCTGCTGGAGTTCGTGA<br>CCGCCGCCGGGATCACTCTCGGCATGGACGAGCTGTACAAatgattgtttattgcagcttata<br>atggttacaaataaagcaatagcatcacaaatttcacaaataaagcatttttttcactgcattctagttgtggttt<br>gtccaaactcatcaatgtatcttatGAAGGCAAGGAGAGAATGTATGAAGAACAGTCACAGG<br>ACAGGTAAGAAGAATATTTCAGATGTTTTGGTGTAAAGGTCATTTATGTTGCTTTTTA | 2541 |

TABLE 5-continued

CONSTRUCTS USED FOR EVALUATION OF PREDICTED LOCI

| Construct name | Sequence | Length |
|---|---|---|
| | CTTAATAGTTAACCTAAACGTCACCATGTAATTGTTTTGGGGTAAATGTGAGTCGCTT<br>TGTATATAgtcatgtggtacttaacgatggggatactttacaagaaatgcatttttagacaatttcattgttgt<br>gtggacatgatagagtgtacttacacagagctagatggtattacctaccgcacacctaggctgtatgatgtagc<br>ctattgctcctaggctgcaaatctatacagtatgttactgtactgaatactgtgggcagttgtaacacaatggta<br>agtatgtgtgtatctaaatatacctaaacatagaaaaggtatggtaaaaatactgtataaaaggccgggcgtg<br>g (SEQ ID NO: 212) | |
| pARBI-608:<br>CD2_1_Exo<br>genous_13_<br>14_15 | AGATGAGAAAACCTATCCTTCCCAATTTTTTGTGTGAGAATTAAAATGCAGCAAGA<br>AAACACACACTCATAAACACATCTGCTTTGGCAAAGGAGCACATCAGAAGGGCTGG<br>CTTGTGCGCGCTCTTGCTCTCTGTGTATGTGTATTATGTTTTATGTTACTGTAAAAGAT<br>GTAAAGAGAGGCACGTGGTTAAGCTCTCGGGGTGTGGACTCCACCAGTCTCACTTC<br>AGTTCCTTTTGCATGAAGAGCTCAGAATCAAAAGAGGAAACCAACCCCTAAGATGA<br>GCTTTCCATGTAAATTTGTAGCCAGCTTCCTTCTGATTTTCAATGTTTCTTCCAAAGGT<br>AAGCATAAGAGTCAAAGAAGTCCCAACCCAGCTTTCCCTGAAAGTGACTCTCAGTAA<br>CTCTTTTGCTTTTTATAGGTGCAGTCTCCAAAGAGATTACGAATGCCTTGtgacgactgtg<br>ccttctagttgccagccatctgttgtttgcccctccccgtgccttccttgaccctggaaggtgccactcccactgt<br>cctttcctaataaaatgaggaaattgcatcgcattgtctgagtaggtgtcattctattctgggggtggggtggg<br>gcaggacagcaagggggaggattgggaagacaatagcaggcatgctggggatgcggtgggctctatggGG<br>ATCTGCGATCGCTCCGGTGCCCGTCAGTGGGCAGAGCGCACATCGCCCACAGTCCCC<br>GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcatttttttcactgcattctagttgtggtt<br>tgtccaaactcatcaatgtatcttatGAAACCTGGGGTGCCTTGGGTCAGGACATCAACTTGG<br>ACATTCCTAGTTTTCAAATGAGTGATGATATTGACGATATAAAATGGGAAAAAACTT<br>CAGACAAGAAAAAGATGCACAATTCAGAAAAGAGAAAGAGACTTTCAAGGAAAA<br>AGATACATATAAGCTATTTAAAAATGGAACTCTGAAAATTAAGCATCTGAAGACCGA<br>TGATCAGGATATCTACAAGGTATCAATATATGATACAAAAGGAAAAAATGTGTTGG<br>AAAAAATATTTGATTTGAAGATTCAAGGTAAGTGTTCATTCCCTTAATTGCTTTATTTC<br>AGTGTGGGTGCTATTTTGGCAAGTTGGAAAATAGCATTTCTAATATTCCCCAGCGCTG<br>ACCTCTGCCTCCAGGGGGGCTATACAGGAAACCAGATGCATGTCTCCTGCCCCAGTG<br>GAGACTGTGGTCCAA (SEQ ID NO: 213) | 2541 |
| pARBI-609:<br>CD3E_1_Ex<br>ogenous_1<br>6 | AGGATTGTTCTAGTTGATTGGTATGTGTGCACTCCTAGTTGTTAAATATTTTCACTAT<br>CACACCTGGATATACTCAACAAATATTTGTTGAGCCAAATACTCAACACCAGCCAAA<br>CACGTAGTATTTACTTTAGCTTAAGCGAATTATTTAGCCCTGACAGAAGCCCTGGAAT<br>GTGGGTCTTTAAGTTCCTATTTTTGAGATGGGAAAGCTGAGGCTCACGGAAGGAGG<br>TGACCAGCTCAAGTCTCCTACCGTCCATGCCAAATTAGAATTCCAGCCTGCCTCCTGA<br>CTTCAAGTCCAAAGTTCTTCCCACGCACTAAAGCTAGCTCTTCAAGTGTCCTTTCTTAG<br>GAGGTACTTCCTCCCGCACCACTGACCGCCCCTCTCTATTTCACCCCCAGCCCATCC<br>GGAAAGGCCAGCGGGACCTGTATTCTGCCTGAATCAGAGACGCATCtgacgactgtgc<br>cttctagttgccagccatctgttgtttgcccctccccgtgccttccttgaccctggaaggtgccactcccactgtc<br>ctttcctaataaaatgaggaaattgcatcgcattgtctgagtaggtgtcattctattctgggggtggggtgggg<br>caggacagcaagggggaggattgggaagacaatagcaggcatgctggggatgcggtgggctctatggGGA<br>TCTGCGATCGCTCCGGTGCCCGTCAGTGGGCAGAGCGCACATCGCCCACAGTCCCC<br>GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG | 2541 |

TABLE 5-continued

CONSTRUCTS USED FOR EVALUATION OF PREDICTED LOCI

| Construct name | Sequence | Length |
|---|---|---|
| | CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcatttttttcactgcattctagttgtggtt<br>tgtccaaactcatcaatgtatcttatTGACCCTCTGGAGAACACTGCCTCCCGCTGGCCCAGGT<br>CTCCTCTCCAGTCCCCCTGCGACTCCCTGTTTCCTGGGCTAGTCTTGGACCCCACGAG<br>AGAGAATCGTTCCTCAGCCTCATGGTGAACTCGCGCCCTCCAGCCTGATCCCCCGCT<br>CCCTCCTCCCTGCCTTCTCTGCTGGTACCCAGTCCTAAAATATTGCTGTTCCTCTTCC<br>TTTGAAGCATCATCAGTAGTCACACCCTCACAGCTGGCCTGCCCTCTTGCCAGGATAT<br>TTATTTGTGCTATTCACTCCCTTCCCTTTGGATGTAACTTCTCCGTTCAGTTCCCTCCTT<br>TTCTTGCATGTAAGTTGTCCCCCATCCCAAAGTATTCCATCTACTTTTCTATCGCCGTC<br>CCCTTTTGCAGCCCTCTCTGGGGATGGACTGGGTAAATGTTGACAGAGGCCCTGCCC<br>CGTT (SEQ ID NO: 214) | |
| pARB1-610:<br>CD3E_2_Ex<br>ogenous_1<br>7_18 | AATAATAAAATAATAACAATACTTAACATTTATTGAGTGCTTATTAAGTCTCAAGCAC<br>TGTCTGTACCCAACACTTATCAAGGATTCTTTTTCATGTAATCCTCTCAACAACTATAT<br>GGGTTAAGTATCATTTTATTCCCATGAGTAAAGGGATGAGGAAACAGAGGGTTTGT<br>GAGTTGAAAACACATTTCACGCTTCTCACAGCTAGTGAGTAATAAAGCTGGGACTCA<br>AACCCAGGGCTGTTTGACTCCAGTGCCTCTACCCACGGCCACCACTCTTTGCTTGTCA<br>ATGTTGTTCTAAACATATTGAAGGGGGGGCTCTGACCGTGGCAAGCGTGTGAGTAG<br>TAAGGGGAGAATGGCCTTCATGCACTCCCTCCTCACCTCCAGCGCCTTGTGTTTTCCT<br>TGCTTAGTGATTTCCCCTCTCCCACCCCACCCCCCACAGTGTGTGAGtgacgactgtgcc<br>ttctagttgccagccatctgttgtttgcccctccccgtgccttccttgaccctggaaggtgccactcccactgtcc<br>tttcctaataaaatgaggaaattgcatcgcattgtctgagtaggtgtcattctattctgggggtggggtggggc<br>aggacagcaaggggggaggattgggaagacaatagcaggcatgctgggatgcggtgggctctatggGGAT<br>CTGCGATCGCTCCGGTGCCCGTCAGTGGGCAGAGCGCACATCGCCCACAGTCCCCG<br>AGAAGTTGGGGGGAGGGGTCGGCAATTGAACGGGTGCCTAGAGAAGGTGGCGCG<br>GGGTAAACTGGGAAAGTGATGTCGTGTACTGGCTCCGCCTTTTTCCCGAGGGTGGG<br>GGAGAACCGTATATAAGTGCAGTAGTCGCCGTGAACGTTCTTTTTCGCAACGGGTTT<br>GCCGCCAGAACACAGCTGAAGCTTCGAGGGGCTCGCATCTCTCCTTCACGCGCCCGC<br>CGCCCTACCTGAGGCCGCCATCCACGCCGGTTGAGTCGCGTTCTGCCGCCTCCCGCC<br>TGTGGTGCCTCCTGAACTGCGTCCGCCGTCTAGGTAAGTTTAAAGCTCAGGTCGAGA<br>CCCGGGCCTTTGTCCGGCGCTCCCTTGGAGCTACCTAGACTCAGCCGGCTCTCCACG<br>CTTTTGCCTGACCCTGCTTGCTCAACTCTACGTCTTTGTTTCGTTTTCTGTTCTGCGCCG<br>TTACAGATCCAAGCTGTGACCGGCGCCTACTCTAGAGCTAGCGAATTgccgccaccATG<br>GTGAGCAAGGGCGAGGAGCTGTTCACCGGGGTGGTGCCCATCCTGGTCGAGCTGG<br>ACGGCGACGTAAACGGCCACAAGTTCAGCGTGTCCGGCGAGGGCGAGGGCGATGC<br>CACCTACGGCAAGCTGACCCTGAAGTTCATCTGCACCACCGGCAAGCTGCCCGTGCC<br>CTGGCCCACCCTCGTGACCACCCTGACCTACGGCGTGCAGTGCTTCAGCCGCTACCC<br>CGACCACATGAAGCAGCACGACTTCTTCAAGTCCGCCATGCCCGAAGGCTACGTCCA<br>GGAGCGCACCATCTTCTTCAAGGACGACGGCAACTACAAGACCCGCGCCGAGGTGA<br>AGTTCGAGGGCGACACCCTGGTGAACCGCATCGAGCTGAAGGGCATCGACTTCAAG<br>GAGGACGGCAACATCCTGGGGCACAAGCTGGAGTACAACTACAACAGCCACAACGT<br>CTATATCATGGCCGACAAGCAGAAGAACGGCATCAAGGTGAACTTCAAGATCCGCC<br>ACAACATCGAGGACGGCAGCGTGCAGCTCGCCGACCACTACCAGCAGAACACCCCC<br>ATCGGCGACGGCCCCGTGCTGCTGCCCGACAACCACTACCTGAGCACCCAGTCCAA<br>GCTGAGCAAAGACCCCAACGAGAAGCGCGATCACATGGTCCTGCTGGAGTTCGTGA<br>CCGCCGCCGGGATCACTCTCGGCATGGACGAGCTGTACAAatgattgtttattgcagcttata<br>atggttacaaataaagcaatagcatcacaaatttcacaaataaagcatttttttcactgcattctagttgtggttt<br>gtccaaactcatcaatgtatcttatAACTGCATGGAGATGGATGTCGGTGGCCACAAT<br>TGTCATAGTGGACATCTGCATCACTGGGGGCTGCTGCTGCTGGTTTACTACTGGAG<br>CAAGAATAGAAAGGCCAAGGCCAAGCCTGTGACACGAGGAGCGGGTGCTGGCGGC<br>AGGCAAAGGGGTAAGGCTGTGGAGTCCAGTCAGAGGAGATTCCTGCCAAGGGGGA<br>CGACCAGCCTGGGCCAGGGTGGGTGGCAAGTCCACAGCTAGGTCAGAACAGCTTCT<br>CTAGAGCTTCTATGCACAGCTTCTATTACTGTGATGACAAGATCTCAACAGACGGTTT<br>CAAATCTCACATCACTCCCCTCCTTCCCATCCTAGAAAAGTGCAAAAAAGTTTATGAA<br>AGTGATGGGCTTCCTCACATACCTGTCAATGCCTGCAGTCATCCGATTCCGCCCCTAA<br>GCTGTGGGAAGAGAG (SEQ ID NO: 215) | 2541 |
| pARBI-611:<br>CD3G_1_Ex<br>ogenous_1<br>9_20 | ACTGTGACCCATGAACCAGTAGGTATTGGCGTCACCTGGGATCCTGACGTTAGTCTC<br>TGTCAATCCTTCTCTTTAGTTCATCTATTCTACCCAAAGTGATCTCATCATCTGGTATG<br>CTGTTAGCAGTTTCTTACCTGTATAGTATCTTCCAAATAACATGCCCCAAAATCCCAA<br>AGTTTTACCCCTACTAATTACAGCAATGTCTCTTTTATTCTTCACCCCCTGACGCAGAT<br>ATTGGCGTCACCCGAGAGCATGTTAGTAATGCAGAATCTCCCCTCCCCAGAACTACT<br>AAATAGCACCTGAAATTTTAACAAGATCCCCATGTGATTCATGTGCACATCAAAGTTT<br>GAGAAACACTACTCTAATGATCTCCTGGTATGCAGAAGCAGGGAGAATTTCAGAGG<br>CAAGATCCTTAATAGAACCACGGCTTTTCTCATTTCAGGAAACCACtgacgactgtgccttc | 2541 |

TABLE 5-continued

CONSTRUCTS USED FOR EVALUATION OF PREDICTED LOCI

| Construct name | Sequence | Length |
|---|---|---|
| | tagttgccagccatctgttgtttgccctccccgtgccttccttgaccctggaaggtgccactcccactgtcctttcctaataaaatgaggaaattgcatcgcattgtctgagtaggtgtcattctattctgggggtggggtggggcaggacagcaaggggaggattgggaagacaatagcaggcatgctggggatgcggtgggctctatggGATCTGCGATCGCTCCGGTGCCCGTCAGTGGGCAGAGCGCACATCGCCCACAGTCCCCGAGAAGTTGGGGGGAGGGGTCGGCAATTGAACGGGTGCCTAGAGAAGGTGGCGCGGGGTAAACTGGGAAAGTGATGTCGTGTACTGGCTCCGCCTTMCCCGAGGGTGGGGGAGAACCGTATATAAGTGCAGTAGTCGCCGTGAACGTTCTTTTTCGCAACGGGTTTGCCGCCAGAACACAGCTGAAGCTTCGAGGGGCTCGCATCTCTCCTTCACGCGCCCGCCGCCCTACCTGAGGCCGCCATCCACGCCGGTTGAGTCGCGTTCTGCCGCCTCCCGCCTGTGGTGCCTCCTGAACTGCGTCCGCCGTCTAGGTAAGTTTAAAGCTCAGGTCGAGACCGGGCCTTTGTCCGGCGCTCCCTTGGAGCCTACCTAGACTCAGCCGGCTCTCCACGCTTTGCCTGACCCTGCTTGCTCAACTCTACGTCTTTGTTTCGTTTTCTGTTTCTGCGCCGTTACAGATCCAAGCTGTGACCGGCGCCTACTCTAGAGCTAGCGAATTgccgccaccATGGTGAGCAAGGGCGAGGAGCTGTTCACCGGGGTGGTGCCCATCCTGGTCGAGCTGGACGGCGACGTAAACGGCCACAAGTTCAGCGTGTCCGGCGAGGGCGAGGGCGATGCCACCTACGGCAAGCTGACCCTGAAGTTCATCTGCACCACCGGCAAGCTGCCCGTGCCCTGGCCCACCCTCGTGACCACCCTGACCTACGGCGTGCAGTGCTTCAGCCGCTACCCCGACCACATGAAGCAGCACGACTTCTTCAAGTCCGCCATGCCCGAAGGCTACGTCCAGGAGCGCACCATCTTCTTCAAGGACGACGGCAACTACAAGACCCGCGCCGAGGTGAAGTTCGAGGGCGACACCCTGGTGAACCGCATCGAGCTGAAGGGCATCGACTTCAAGGAGGACGGCAACATCCTGGGGCACAAGCTGGAGTACAACTACAACAGCCACAACGTCTATATCATGGCCGACAAGCAGAAGAACGGCATCAAGGTGAACTTCAAGATCCGCCACAACATCGAGGACGGCAGCGTGCAGCTCGCCGACCACTACCAGCAGAACACCCCCATCGGCGACGGCCCCGTGCTGCTGCCCGACAACCACTACCTGAGCACCCAGTCCAAGCTGAGCAAAGACCCCAACGAGAAGCGCGATCACATGGTCCTGCTGGAGTTCGTGACCGCCGCCGGGATCACTCTCGGCATGGACGAGCTGTACAAAtgattgtttattgcagcttataatggttacaaataaagcaatagcatcacaaatttcacaaataaagcatttttttcactgcattctagttgtggtttgtccaaactcatcaatgtatcttatTTGGTTAAGGTGTATGACTATCAAGAAGATGGTTCGGTACTTCTGACTTGTGATGCAGAAGCCAAAAATATCACATGGTTTAAAGATGGGAAGATGATCGGCTTCCTAACTGAAGATaaaaaaaaaaTGGAATCTGGGAAGTAATGCCAAGGACCCTCGAGGGATGTATCAGTGTAAAGGATCACAGAACAAGTCAAAACCACTCCAAGTGTATTACAGAAGTATGTAATCCCCTTTGGTCTGTTTGTTGTGAAATTAATCAGTATTTGCTGTTCTGGTGAGCTTTTATCTGGGGTGAAAGTGGAAATAGATCCTCAACAGTAATATTATCGCCTGTTCTCTTAATTTCAGCTTGCCTCTTTTAAAATACTGTAAGATACTTCCCTCACCCTATTGAAAAACTACAGCCAGTCCTGTAAAATTTTGTTTACCTTTGGGTGGGCTCCATGG (SEQ ID NO: 216) | |
| pARBI-612: CD3G_3_Exogenous_21 | TTCGAGACAAGCCTGGCCAACATGATGAAACTCTGTCTCTACTAAAAATACAAAAAAAATTAACCAGGCGTGGAGGCGCGCGCCTGTAGTCCCAGCTACTCAGGAGGCTGAGGCAGGAGGACCACTTGAACCCAGGAGGTCGAGGTTGCAGTGAGCTGCGATTGTGCCACTGCACTCCAGCCTGGGCAACAGAGAAAGACTCCGTCTCAAAAAAAAAAAAGAGAGAGAGAAAAGAAAAAAGACAGAGCCTCCATCTCCTTGTCCTCTTTCCATCCTCAGGACCATGAAGTACCCACTCCAAATTCTCACATATAAAAAACATTCAATAAACATGCATCAAATTAATTAATAGAGGATGGAAAAAATGACTTATGACTGTGCTGTCCTTTCCAGCCCCTCAAGGATCGAGAAGATGACCAGTACAGCCACCTTCAAGGAAACCAGTTGtgacgactgtgccttctagttgccagccatctgttgtttgccctccccgtgccttccttgaccctggaaggtgccactcccactgtcctttcctaataaaatgaggaaattgcatcgcattgtctgagtaggtgtcattctattctgggggtggggtggggcaggacagcaaggggaggattgggaagacaatagcaggcatgctggggatgcggtgggctctatggGATCTGCGATCGCTCCGGTGCCCGTCAGTGGGCAGAGCGCACATCGCCCACAGTCCCCGAGAAGTTGGGGGGAGGGGTCGGCAATTGAACGGGTGCCTAGAGAAGGTGGCGCGGGGTAAACTGGGAAAGTGATGTCGTGTACTGGCTCCGCCTTTTTTCCCGAGGGTGGGGGAGAACCGTATATAAGTGCAGTAGTCGCCGTGAACGTTCTTTTTCGCAACGGGTTTGCCGCCAGAACACAGCTGAAGCTTCGAGGGGCTCGCATCTCTCCTTCACGCGCCCGCCGCCCTACCTGAGGCCGCCATCCACGCCGGTTGAGTCGCGTTCTGCCGCCTCCCGCCTGTGGTGCCTCCTGAACTGCGTCCGCCGTCTAGGTAAGTTTAAAGCTCAGGTCGAGACCGGGCCTTTGTCCGGCGCTCCCTTGGAGCCTACCTAGACTCAGCCGGCTCTCCACGCTTTGCCTGACCCTGCTTGCTCAACTCrACGTCTTTGTTTCGTmCTGTTCTGCGCCGTTACAGATCCAAGCTGTGACCGGCGCCTACTCTAGAGCTAGCGAATTgccgccaccATGGTGAGCAAGGGCGAGGAGCTGTTCACCGGGGTGGTGCCCATCCTGGTCGAGCTGGACGGCGACGTAAACGGCCACAAGTTCAGCGTGTCCGGCGAGGGCGAGGGCGATGCCACCTACGGCAAGCTGACCCTGAAGTTCATCTGCACCACCGGCAAGCTGCCCGTGCCCTGGCCCACCCTCGTGACCACCCTGACCTACGGCGTGCAGTGCTTCAGCCGCTACCCCGACCACATGAAGCAGCACGACTTCTTCAAGTCCGCCATGCCCGAAGGCTACGTCCAGGAGCGCACCATCTTCTTCAAGGACGACGGCAACTACAAGACCCGCGCCGAGGTGAAGTTCGAGGGCGACACCCTGGTGAACCGCATCGAGCTGAAGGGCATCGACTTCAAGGAGGACGGCAACATCCTGGGGCACAAGCTGGAGTACAACTACAACAGCCACAACGTCTATATCATGGCCGACAAGCAGAAGAACGGCATCAAGGTGAACTTCAAGATCCGCCACAACATCGAGGACGGCAGCGTGCAGCTCGCCGACCACTACCAGCAGAACACCCCCATCGGCGACGGCCCCGTGCTGCTGCCCGACAACCACTACCTGAGCACCCAGTCCAAGCTGAGCAAAGACCCCAACGAGAAGCGCGATCACATGGTCCTGCTGGAGTTCGTGACCGCCGCCGGGATCACTCTCGGCATGGACGAGCTGTACAAAtgattgtttattgcagcttataatggttacaaataaagcaatagcatcacaaatttcacaaataaagcatttttttcactgcattctagttgtggtttgtccaaactcatcaatgtatcttatAGGAGGAATTGAACTCAGGACTCAGAGTAGGTGGGTTCTTCAATGCCAATTCTAATAAAGGACCCTTGCATCAACTGCCCTCGCAATTGCTTCTAAGTCTAGCTCCCTTCCCTAAGCGGCTATAAGCATCAGACTCTGGGGATCAG | 2541 |

TABLE 5-continued

CONSTRUCTS USED FOR EVALUATION OF PREDICTED LOCI

| Construct name | Sequence | Length |
|---|---|---|
| | GGATTGGGACGTGGTTTGGGGTACTCTTTTCTAAAAATTCTGGGGCCATACTGATTG<br>TCTTGGCCTAGGTAAATATGAATTTTATGTATCTGTAAATCCTGTCAGAGCAGGGCCT<br>CAAGCCATAGAGATGCTGAATATTAATCTTAACCTACATTTGAATTTCTCATTATCTA<br>CACTATTAACATTTTGGGCTAATTAATTATTTGTGATGAGGGGCTAGCCTGTGCATTG<br>TAGGAGTTATGGAAGCATCCCTGGCCTCTCTCCACCAGATGCTGGTAGATTGTCCAG<br>TGTGACAATCAAAAAT (SEQ ID NO: 217) | |
| pARBI-613:<br>CD5_1_Exo<br>genous_22 | GACCTCAGGTGATCTGCCCGCCTCAGCTTCCCAAAGTGCTGGGATTACAGGCATGAG<br>CCACCACACCTGGCCTAAAATTAATTTTTAAAGATCTCTTAAAAAGCAGACACCAGCC<br>CCAATCTCAGACCCCTTGAGACAGAATTTCCAGGACAGGGGCCATCCTGCTGGACA<br>GTGGGTGCCGAGAACACCTTGCCCATTTATCTGAGCTCCCTTCTGACTCTGAAATCTG<br>GAGCCCCACCCTCCTGGGTCTAGCTTCGGGGCTGCCTGGGTCAGGGTCCTCTGGGA<br>AGCCCCTGCAGTGCCCCAGAAGGGACGAAGCTCACAAGGGGCAAGGCAGGCAGCC<br>CACGGGGCAGGAGGGAGCTCAACTGGGCGTCCTAGGGAGAGGGCAGTGAGGGGT<br>GCCAGTGGGGAACCCCTCCCAGCCTGACCCCCACCACACCTTTCTGACCCCCAGATtg<br>acgactgtgccttctagttgccagccatctgttgtttgccccctcccccgtgccttccttgaccctggaaggtgccac<br>tcccactgtcctttcctaataaaatgaggaaattgcatcgcattgtctgagtaggtgtcattctattctgggggt<br>ggggtggggcaggacagcaaggggaggattgggaagacaatagcaggcatgctgggatgcggtgggctc<br>tatggGGATCTGCGATCGCTCCGGTGCCCGTCAGTGGGCAGAGCGCACATCGCCCAC<br>AGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcattttttttcactgc<br>attctagttgtggtttgtccaaactcatcaatgtatcttatTTCCAGGCAAGGCTCACCCGTTCCAAC<br>TCGAAGTGCCAGGGCCAGCTGGAGGTCTACCTCAAGGACGGATGGCACATGGTTTG<br>CAGCCAGAGCTGGGGCCGGAGCTCCAAGCAGTGGGAGGACCCCAGTCAAGCGTCA<br>AAAGTCTGCCAGCGGCTGAACTGTGGGGTGCCCTTAAGCCTTGGCCCCTTCCTTGTC<br>ACCTACACACCTCAGAGCTCAATCATCTGCTACGGACAACTGGGCTCCTTCTCCAACT<br>GCAGCCACAGCAGAAATGACATGTGTCACTCTCTGGGCCTGACCTGCTTAGGTGGG<br>TAACTAGCCAGCCACACGGCACCCTGGGCCTGGGCGCCCAGCCCCGAGGAGACTGC<br>CCGAGGCCTGTGATCTAGGGTCTGAGCAGGCTGGTGGAAGGGGTGGGGGGACCCC<br>AGTTTATAACCACTCCCCAAGCACATACC (SEQ ID NO: 218) | 2541 |
| pARBI-614:<br>CD5_2_Exo<br>genous_23 | GGACAGGGGCCATCCTGCTGGACAGTGGGTGCCGAGAACACCTTGCCCATTTATCT<br>GAGCTCCCTTCTGACTCTGAAATCTGGAGCCCCACCCTCCTGGGTCTAGCTTCGGGG<br>CTGCCTGGGTCAGGGTCCTCTGGGAAGCCCCTGCAGTGCCCCAGAAGGGACGAAGC<br>TCACAAGGGGCAAGGCAGGCAGCCCACGGGGCAGGAGGGAGCTCAACTGGGCGT<br>CCTAGGGAGAGGGCAGTGAGGGGTGCCAGTGGGGAACCCCTCCCAGCCTGACCC<br>CACCACACCTTTCTGACCCCCAGATTTCCAGGCAAGGCTCACCCGTTCCAACTCGAAG<br>TGCCAGGGCCAGCTGGAGGTCTACCTCAAGGACGGATGGCACATGGTTTGCAGCCA<br>GAGCTGGGGCCGGAGCTCCAAGCAGTGGGAGGACCCCAGTCAAGCGTCAAAAGTC<br>TGCTgacgactgtgccttctagttgccagccatctgttgtttgccccctcccccgtgccttccttgaccctggaagg<br>tgccactcccactgtcctttcctaataaaatgaggaaattgcatcgcattgtctgagtaggtgtcattctattctg<br>ggggtggggtggggcaggacagcaaggggaggattgggaagacaatagcaggcatgctgggatgcggt<br>gggctctatggGGATCTGCGATCGCTCCGGTGCCCGTCAGTGGGCAGAGCGCACATCGC<br>CCACAGTCCCCGAGAAGTTGGGGGGAGGGGTCGGCAATTGAACGGGTGCCTAGAG<br>AAGGTGGCGCGGGGTAAACTGGGAAAGTGATGTCGTGTACTGGCTCCGCCTTTTC<br>CCGAGGGTGGGGGAGAACCGTATATAAGTGCAGTAGTCGCCGTGAACGTTCTTTTT<br>CGCAACGGGTTTGCCGCCAGAACACAGCTGAAGCTTCGAGGGGCTCGCATCTCTCCT<br>TCACGCGCCCGCCGCCCTACCTGAGGCCGCCATCCACGCCGGTTGAGTCGCGTTCTG<br>CCGCCTCCCGCCTGTGGTGCCTCCTGAACTGCGTCCGCCGTCTAGGTAAGTTTAAAG<br>CTCAGGTCGAGACCGGGCCTTTGTCCGGCGCTCCCTTGGAGCCTACCTAGACTCAGC<br>CGGCTCTCCACGCTTTGCCTGACCCTGCTTGCTCAACTCTACGTCTTTGTTTCGTTTTC<br>TGTTCTGCGCCGTTACAGATCCAAGCTGTGACCGGCGCCTACTCTAGAGCTAGCGAA<br>TTgccgccaccATGGTGAGCAAGGGCGAGGAGCTGTTCACCGGGGTGGTGCCCATCCT<br>GGTCGAGCTGGACGGCGACGTAAACGGCCACAAGTTCAGCGTGTCCGGCGAGGGC | 2541 |

TABLE 5-continued

CONSTRUCTS USED FOR EVALUATION OF PREDICTED LOCI

| Construct name | Sequence | Length |
|---|---|---|
| | GAGGGCGATGCCACCTACGGCAAGCTGACCCTGAAGTTCATCTGCACCACCGGCAA<br>GCTGCCCGTGCCCTGGCCCACCCTCGTGACCACCCTGACCTACGGCGTGCAGTGCTT<br>CAGCCGCTACCCCGACCACATGAAGCAGCACGACTTCTTCAAGTCCGCCATGCCCGA<br>AGGCTACGTCCAGGAGCGCACCATCTTCTTCAAGGACGACGGCAACTACAAGACCC<br>GCGCCGAGGTGAAGTTCGAGGGCGACACCCTGGTGAACCGCATCGAGCTGAAGGG<br>CATCGACTTCAAGGAGGACGGCAACATCCTGGGGCACAAGCTGGAGTACAACTACA<br>ACAGCCACAACGTCTATATCATGGCCGACAAGCAGAAGAACGGCATCAAGGTGAAC<br>TTCAAGATCCGCCACAACATCGAGGACGGCAGCGTGCAGCTCGCCGACCACTACCA<br>GCAGAACACCCCCATCGGCGACGGCCCCGTGCTGCTGCCCGACAACCACTACCTGA<br>GCACCCAGTCCAAGCTGAGCAAAGACCCCAACGAGAAGCGCGATCACATGGTCCTG<br>CTGGAGTTCGTGACCGCCGCCGGGATCACTCTCGGCATGGACGAGCTGTACAAatga<br>ttgtttattgcagcttataatggttacaaataaagcaatagcatcacaaatttcacaaataaagcatttttttcac<br>tgcattctagttgtggtttgtccaaactcatcaatgtatcttatCAGCGGCTGAACTGTGGGGTGCCC<br>TTAAGCCTTGGCCCCTTCCTTGTCACCTACACACCTCAGAGCTCAATCATCTGCTACG<br>GACAACTGGGCTCCTTCTCCAACTGCAGCCACAGCAGAAATGACATGTGTCACTCTC<br>TGGGCCTGACCTGCTTAGGTGGGTAACTAGCCAGCCACACGGGCACCCTGGGCCTG<br>GGCGCCAGCCCCGAGGAGACTGCCCGAGGCCTGTGATCTAGGGTCTGAGCAGGCT<br>GGTGGAAGGGTGGGGGGACCCCAGTTTATAACCACTCCCCAAGACACATACCCAG<br>GAGGGGGACTGGAAGGGGCCAGCACCCATCTGTAGGATGGCAATGGAGGACCTAG<br>TTCTGCCAATCACTGACTTCATCGTCGCCTCTGAACCTCCATTCTCCCATCTGTGAAGT<br>GGGGTGGTACTTCCCGCCTCGCAGGAGGCT (SEQ ID NO: 219) | |
| pARBI-615:<br>CD5_3_Exo<br>genous_24 | tgctgggattacaggcatgagccaccacacctggcctaaaattaattttttaaagaTCTCTTAAAAAGCAG<br>ACACCAGCCCCAATCTCAGACCCCTTGAGACAGAATTTCCAGGACAGGGGCCATCCT<br>GCTGGACAGTGGGTGCCGAGAACCTTGCCCATTTATCTGAGCTCCCTTCTGACTC<br>TGAAATCTGGAGCCCACCCTCCTGGGTCTAGCTTCGGGGCTGCCTGGGTCAGGGTC<br>CTCTGGGAAGCCCCTGCAGTGCCCCAGAAGGGACGAAGCTCACAAGGGGCAAGGC<br>AGGCAGCCCACGGGGCAGGAGGGAGCTCAACTGGGCGTCTAGGGAGAGGGCAG<br>TGAGGGGTGCCAGTGGGGAACCCCTCCCAGCCTGACCCCCACCACACCTTTCTGACC<br>CCCAGATTTCCAGGCAAGGCTCACCCGTTCCAACTCGAAGTGCtgacgactgtgcctttctag<br>ttgccagccatctgttgtttgccctccccgtgccttccttgacctggaaggtgccactccactgtcctttcct<br>aataaaatgaggaaattgcatcgcattgtctgagtaggtgtcattctattctgggggtgggtggggcaggac<br>agcaaggggaggattgggaagacaatagcaggcatgctaggcaggcatgctgggctctatggGGATCTGC<br>GATCGCTCCGGTGCCCGTCAGTGGGCAGAGCGCACATCGCCCACAGTCCCCGAGAA<br>GTTGGGGGGAGGGGTCGGCAATTGAACGGGTGCCTAGAGAAGGTGGCGCGGGT<br>AAACTGGGAAAGTGATGTCGTGTACTGGCTCCGCCTTTTTCCCGAGGGTGGGGGAG<br>AACCGTATATAAGTGCAGTAGTCGCCGTGAACGTTCTTTTTCGCAACGGGTTTGCCG<br>CCAGAACACAGCTGAAGCTTCGAGGGGCTCGCATCTCTCCTTCACGCGCCCGCCGCC<br>CTACCTGAGGCCGCCATCCACGCCGGTTGAGTCGCGTTCTGCCGCCTCCCGCCTGTG<br>GTGCCTCCTGAACTGCGTCCGCCGTCTAGGTAAGTTTAAAGCTCAGGTCGAGACCGG<br>GCCTTTGTCCGGCGCTCCCTTGGAGCCTACCTAGAGCTCAGCCGGCTCTCCACGCMG<br>CCTGACCCTGCTTGCTCAACTCTACGTCTTTGTTTCGTTTTCTGTTCTGCGCCGTTACA<br>GATCCAAGCTGTGACCGGCGCCTACTCTAGAGCTAGCGAATTgccgccaccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttcactgcattctagttgtggtttgtcc<br>aaactcatcaatgtatcttatCAGGGCCAGCTGGAGGTCTACCTCAAGGACGGATGGCACA<br>TGGTTTGCAGCCAGAGCTGGGCCGGAGCTCCAAGCAGTGGGAGGACCCCAGTCA<br>AGCGTCAAAAGTCTGCCAGCGGCTGAACTGTGGGTGCCCTTAAGCCTTGGCCCCTT<br>CCTTGTCACCTACACACCTCAGAGCTCAATCATCTGCTACGGACAACTGGGCTCCTTC<br>TCCAACTGCAGCCACAGCAGAAATGACATGTGTCACTCTCTGGGCCTGACCTGCTTA<br>GGTGGGTAACTAGCCAGCCACACGGGCACCCTGGGCCTGGGCGCCAGCCCCGAGG<br>AGACTGCCCGAGGCCTGTGATCTAGGGTCTGAGCAGGCTGGTGGAAGGGTGGGG<br>GGACCCCAGTTTATAACCACTCCCCAAGACACATACCCAGGAGGGGGACTGGAAGG<br>GGCCAGCACCCATCTGT (SEQ ID NO: 220) | 2541 |
| pARB1-616:<br>chr2_1_Exo<br>genous_10 | TGTCCAAAGTGTGTGTCACCTGCTCTGTGTTCACCCACTGGGTTCATCAGAGGGGCA<br>CTTGAACAAAACAGGAATGTCACTGGAGAGGGGAACAAATGCTGTCCCCAAGTCCT<br>TCCCTGCCGTTTAGAGTAACGCAGCCCCTGTCCGCACATCCTCACCCCCCATCTGCCCT<br>6CTGCTTGCCAGAATTATCAGAATCTCTCAATTCTAATTTCAGCCATTCTCTGTGAAAAT<br>GAAAAGTTAGTGGCAGGCAATGGACACCCTATTGAAATAGAAATTGTTCTTCATATG<br>TCAGAAAAGTCCCAGAGTAATCTGGGAGTAATCTGAGCAAACTGATTCAAAGGATT<br>ATTACAATTTCTTAGTCTTCTACTGCTGCAAAAGTGGCACTCTTTGATTCTCATGTTTG<br>AGGTTCTAATTACTACCTCATGCAGGACTTACAAGAGATCAGCCATGCtgacgactgtgc | 2541 |

TABLE 5-continued

CONSTRUCTS USED FOR EVALUATION OF PREDICTED LOCI

| Construct name | Sequence | Length |
|---|---|---|
| | cttctagttgccagccatctgttgtttgccccctccccgtgccttccttgaccctggaaggtgccactcccactgtc<br>cttcctaataaaatgaggaaattgcatcgcattgtctgagtaggtgtcattctattctgggggtggggtgggg<br>caggacagcaaggggaggattgggaagacaatagcaggcatgctggggatgcggtgggctctatggGGA<br>TCTGCGATCGCTCCGGTGCCCGTCAGTGGGCAGAGCGCACATCGCCCACAGTCCCC<br>GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcattttttcactgcattctagttgtggtt<br>tgtccaaactcatcaatgtatcttatTGCTTACATTGTGTAGTGAATCAATGTTATTCTGAA<br>GGGCCTCCTGGAAGCAGTAGGGATTGGAGAATGTATGTCTTTTAACATGATCATTCC<br>CATCCTATGGGGGTTGGGCACTCTTAACTCATGTTGCAGATGAGTAAACTGAGGCTT<br>TTGAGAGTTTGAGGGTGCACAGCTTGAGGCAGAGGTGGAATTCCCAGCTTCATCCA<br>AGAAATCACGAATCTCCAATGGCTTGCACACATCCAGGTTTGCTGGATCCTATTTGTC<br>AAGCACACATGCAGATTAGGAGCCTTCAAACAAATTATTTCCAAGGGAGGGCATCTT<br>TCTCTGTAACCCCTACCCTGGCAATTCTCCATGGCCTCAGGGAGTCCAGCCGGAAGC<br>TCTGCAATGAGTCCTGGGGAACTCTCATCTGGAAAAAGGCGCTCATGACAGGTGGT<br>GCCAACCTTCCACG (SEQ ID NO: 221) | |
| pARBI-617:<br>chr2_2_Exo<br>genous_10<br>7 | CTACAAGCATGCATCACCAGGCCTGGCTAATTTTTCTATTTTTTGTAGGGACAGGGTT<br>TTGCTGTGTTGCCCAGGCTGGTCTCAATTTCCTGGACACAAGCAATCTGCCTGCCTCA<br>GCCTCATAATGTTTTTTTTTAATGTTAAACCCCTTCTTGTGTTGAGAGGCCTGGCTTGT<br>GTGTTTGAGCGCAGCTGCCTACCTTTGCAGCTGTAAATGTCAGGGCTCCAGGAGGG<br>CTGGCTGGGTCTCCCCTCCTCCCCTGTTGGGTGGGTGGGCCCTGAGCTTATCCAGG<br>CATCCCTAGGTGGATGGATGGGTGGATGGGTAGGCCCTGGCCTTCAGGGAATGCAC<br>TGTGTGTGGTCTTCCAGCCCCAGCAAAGTCTCAGGGGGCCCGAGCGGGAAGTCGCC<br>ATCCTCAGGGGGTCCGAGTGGGAGTCACCATCCTCACGGTCAGCCGTGGtgacgact<br>gtgccttctagttgccagccatctgttgtttgccccctccccgtgccttccttgaccctggaaggtgccactcccac<br>tgtccttttcctaataaaatgaggaaattgcatcgcattgtctgagtaggtgtcattctattctgggggtggggtg<br>gggcaggacagcaaggggaggattgggaagacaatagcaggcatgctggggatgcggtgggctctatggG<br>GATCTGCGATCGCTCCGGTGCCCGTCAGTGGGCAGAGCGCACATCGCCCACAGTCC<br>CCGAGAAGTTGGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcattttttcactgcattctagttg<br>tggtttgtccaaactcatcaatgtatcttatTTTCGAATTGAGCTCCCAGGGGCGGAGACTCCAT<br>TCCCCCGGGGAACAATCTGATAGCCAGAAATGAGAGCAGTGAGTGACTTGGACGCT<br>GTGTGATTCAGGAGGGTCCCAGTCCCTCAGAGTCGCCTGGACACCAGATTGTATTTA | 2541 |

TABLE 5-continued

CONSTRUCTS USED FOR EVALUATION OF PREDICTED LOCI

| Construct name | Sequence | Length |
|---|---|---|
| | CAAAACAGATGGATGAGGAAATGGAGATTGGGTCTTCAAAAGAATTAACCTCAGAT<br>TTTATTTATTTATTTTAAAAATTTTAATTTTTCCCAAGGACCCTTTCCAAGTCAAGAATT<br>GTTTTAAAAAGAAGCCTGGTGAAGGCAAATGCTGTCTGTGGCCGAAGGCACCGTGA<br>GGAGCTGAGGCTGACTTATGTTTCTCCTCTGGGCTATGTGCGCCTCTAAGGAGTTCA<br>CACACTTTAACCCCCTTAGGAACCCTACATGATCATCCTCGTTTCTTAAAGAGGAAGC<br>AGAGCCAGCAAACAAG (SEQ ID NO: 222) | |
| ARBI-618:<br>chr2_3_Exo<br>genous_10<br>8 | TCTTGATGGATACCCATCCTTCTCTGCTGTTCTCTCTTTCCTCCATCCTCAAGCACAGG<br>GAGCTTTTGGCGAGGTTAGCTAACTTCGGGGCAGCTGTGAATTAGATACTGGCTGT<br>AAGTTACCTCCAACATCCAGAGCATTTAAACGCTCGGCTGTCAATGATTGTCATTTTC<br>ATTGTTTACATATAGTCACATCCTCAGTTTGTGGGGTGGATGCATTTGATTCAATTCA<br>GATATGCCTTTCAAGCTGGCCCTGCTGAGCTGGGCCTGAAAGGCACATGGCTCATCT<br>CATCTGCATGTGACAGTCTCTTTGAAGTCCCCAGAAGTGCCTGCTCAGAGTCATGCT<br>CGGGAGGGAAGAGGTAAGGCACAGAATGAGTACAGACTGCCACCCAGCCGCAGGA<br>AAGGTGACTGCACACCAGAGGTTCCTGGTAAGGAGGTGACTCACCCGCGAtgacgact<br>gtgccttctagttgccagccatctgttgtttgccctccccgtgccttccttgaccctggaaggtgccactcccac<br>tgtcctttcctaataaaatgaggaaattgcatcgcattgtctgagtaggtgtcattctattctgggggtggggtg<br>gggcaggacagcaaggggaggattgggaagacaatagcaggcatgctggggatgcggtgggctctatggG<br>GATCTGCGATCGCTCCGGTGCCCGTCAGTGGGCAGAGCGCACATCGCCCACAGTCC<br>CCGAGAAGTTGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcatttttttcactgcattctagttg<br>tggtttgtccaaactcatcaatgtatcttatCTGTCTCACCTGTCCAAAGTGTGTGTCACCTGCTC<br>TGTGTTCACCCACTGGGTTCATCAGAGGGGCACTTGAACAAAACAGGAATGTCACT<br>GGAGAGGGGAACAAATGCTGTCCCCAAGTCCTTCCCTGCCGTTTAGAGTAACGCAG<br>CCCCTGTCCGCACATCCTCACCCCCATCTGCCCTCTGCTTGCCAGAATTATCAGAATCT<br>CTCAATTCTAATTTCAGCCATTCTCTGTGAAAATGAAAAGTTAGTGGCAGGCAATGG<br>ACACCCTATTGAAATAGAAATTGTTCTTCATATGTCAGAAAAGTCCCAGAGTAATCT<br>GGGAGTAATCTGAGCAAACTGATTCAAAGGATTATTACAATTCTTAGTCTTCTACTG<br>CTGCAAAAGTGGCACTCTTTGATTCTCATGTTTGAGGTTCTAATTACTACCTCATGCA<br>GGACTTACAAGAGA (SEQ ID NO: 223) | 2541 |
| pARBI-619:<br>chr3_1_Exo<br>genous_11<br>21 | TGAGCAAATAGTTCTATCCTTTTTGACACATTTTCCACAGTTTGTATAATTTATTCATA<br>GAATCCTTCTTAGACTACTAATAAAATTCCTATGGGACATAGTCCTTTTATATGCGGAG<br>GAATCCACCACCATGAAATGTTCACAAGAAATGACTTTTAAAATTTTATTTGTGGCCA<br>GCTGATTATGAATTTCTGAATTATGTCTGGGCTGCTCTTTTTCTCGGAATATGCAAA<br>GTGGGATACTGGCATCTCTGTATCTGGAGAGTTACAGCTTCTGAGTTAAAAGATGAA<br>TGGGAAGTAGCAGGAGAGGGAGAGATCAGAAATCTCCACTCCCTGAAACACAGAC<br>ACTTCACATACCCAGGAGGTAAATTCCTGGCATGAATTGTAACAAGTATACACAGGC<br>ATTTGTACATTGTTTGCTTATGTGCTAGATGACATGGCAGTCTATGAAtgacgactgtgcc<br>ttctagttgccagccatctgttgtttgccctccccgtgccttccttgaccctggaaggtgccactcccactgtcc<br>tttcctaataaaatgaggaaattgcatcgcattgtctgagtaggtgtcattctattctgggggtggggtggggc<br>aggacagcaaggggaggattgggaagacaatagcaggcatgctggggatgcggtgggctctatggGGAT<br>CTGCGATCGCTCCGGTGCCCGTCAGTGGGCAGAGCGCACATCGCCCACAGTCCCCCG<br>AGAAGTTGGGGGAGGGGTCGGCAATTGAACGGGTGCCTAGAGAAGGTGGCGCG<br>GGGTAAACTGGGAAAGTGATGTCGTGTACTGGCTCCGCCTTTTTCCCGAGGGTGGG<br>GGAGAACCGTATATAAGTGCAGTAGTCGCCGTGAACGTTCTTTTTCGCAACGGGTTT<br>GCCGCCAGAACACAGCTGAAGCTTCGAGGGGCTCGCATCTCTCCTTCACGCGCCCGC<br>CGCCCTACCTGAGGCCGCCATCCACGCCGGTTGAGTCGCGTTCTGCCGCCTCCCGCC<br>TGTGGTGCCTCCTGAACTGCGTCCGCCGTCTAGGTAAGTTTAAAGCTCAGGTCGAGA<br>CCGGGCCTTTGTCCGGCGCTCCCTTGGAGCCTACCTAGACTCAGCCGGCTCTCCACG<br>CTTTGCCTGACCCTGCTTGCTCAACTCTACGTCTTTGTTTCGTTTTCTGTTCTGCGCCG<br>TTACAGATCCAAGCTGTGACCGGCGCCTACTCTAGAGCTAGCGAATTgccgccaccATG<br>GTGAGCAAGGGCGAGGAGCTGTTCACCGGGGTGGTGCCCATCCTGGTCGAGCTGG<br>ACGGCGACGTAAACGGCCACAAGTTCAGCGTGTCCGGCGAGGGCGAGGGCGATGC | 2541 |

TABLE 5-continued

CONSTRUCTS USED FOR EVALUATION OF PREDICTED LOCI

| Construct name | Sequence | Length |
|---|---|---|
| | CACCTACGGCAAGCTGACCCTGAAGTTCATCTGCACCACCGGCAAGCTGCCCGTGCC<br>CTGGCCCACCCTCGTGACCACCCTGACCTACGGCGTGCAGTGCTTCAGCCGCTACCC<br>CGACCACATGAAGCAGCACGACTTCTTCAAGTCCGCCATGCCCGAAGGCTACGTCCA<br>GGAGCGCACCATCTTCTTCAAGGACGACGGCAACTACAAGACCCGCGCCGAGGTGA<br>AGTTCGAGGGCGACACCCTGGTGAACCGCATCGAGCTGAAGGGCATCGACTTCAAG<br>GAGGACGGCAACATCCTGGGGCACAAGCTGGAGTACAACTACAACAGCCACAACGT<br>CTATATCATGGCCGACAAGCAGAAGAACGGCATCAAGGTGAACTTCAAGATCCGCC<br>ACAACATCGAGGACGGCAGCGTGCAGCTCGCCGACCACTACCAGCAGAACACCCCC<br>ATCGGCGACGGCCCCGTGCTGCTGCCCGACAACCACTACCTGAGCACCCAGTCCAA<br>GCTGAGCAAAGACCCCAACGAGAAGCGCGATCACATGGTCCTGCTGGAGTTCGTGA<br>CCGCCGCCGGGATCACTCTCGGCATGGACGAGCTGTACAAatgattgtttattgcagcttata<br>atggttacaaataaagcaatagcatcacaaatttcacaaataaagcattttttcactgcattctagttgtggttt<br>gtccaaactcatcaatgtatcttatCAGGGGCCCCACATCTGCAGGCAGGACATTCAGCCCTG<br>TATCTTGCCACTACCATGAAATCTGAGGTTCTTTCATTTTTGTTTTTCTATTCTGATGA<br>GATTGAGGTACACTGACTCACTGGTAAAGAAGACAATTTATTTGTGAACTTGTAGTC<br>ACTCCATTTGACGGCCTCCCTCTACTCACTGAGGCACAGCACGTGTGGAACAGGAAA<br>AAGGCCTCTGGAGAGCTTGTGTTCCACTGGTTTCTTTGACTTTTGCCAACCAACTTTG<br>CAAATGTTCTCAAAAGGCATTCATTACCTCTGCAGGTGTGAAATAACTCTGCAGTTCA<br>AGGGTTTGTGAAATCACGTGAAACAGCTGAAAGCTGTTCTGGCAAAGCGACCAGAG<br>TCAGAGTTAGCTGTCACCAAGCCACATCCTGGCTTAAACGATGTTATTTATATCTAAC<br>TGCACTCGA (SEQ ID NO: 224) | |
| pARBI-620:<br>chr3_2_Exo<br>genous_11<br>3 | AGATGCCCATTGTACCACCTACCATTGCTTGACCCCCGCCCATGAGCTGTTCCTTCAT<br>ACTCATAACTAAAATGCCAAATGTGTGACTTGAGTAATTAACTAGAGACCTCCAGAA<br>GGCTTTCCTTCTTATTCTGGGTACATTGATATTTACTTTAGTATTTGTTTTGCCTTTAAA<br>GTCATGTTCCCTTTTGATTCTTTAATATCATATCCAAAACGAAGTCCTTTTAACCTATA<br>ACAATGCAAATCAAAAGTGCTGTCTTTCAGCTACCTCAAGGATTTAGCAAGCGTTCC<br>TGGAAATCTAACCAACCTTTTAAAAAGTATTTCTATGGGAATGTATTTCTGAGCCCTA<br>AATTATGGATTTTGAAACTAAAATAGAAGAATACTGTAAGTGCAAAACTTCCCAGTAG<br>ATAACAGAATTTGCAAAATCTCTAATCTCTTGTATGTGCCCCAAtgacgactgtgccttctag<br>ttgccagccatctgttgtttgccctccccgtgccttccttgacctggaaggtgccactcccactgtccttcct<br>aataaaatgaggaaattgcatcgcattgtctgagtaggtgtcattctattctgggggtgggtggcaggac<br>agcaaggggaggattgggaagacaatagcaggcatgctgaggatgcggtgggctctatgGGATCTGC<br>GATCGCTCCGGTGCCCGTCAGTGGGCAGAGCGCACATCGCCCACAGTCCCCGAGAA<br>GTTGGGGGGAGGGGTCGGCAATTGAACGGGTGCCTAGAGAAGGTGGCGCGGGT<br>AAACTGGGAAAGTGATGTCGTGTACTGGCTCCGCCTTTTTCCCGAGGGTGGGGGAG<br>AACCGTATATAAGTGCAGTAGTCGCCGTGAACGTTCTTTTTGGCCAACGGGTTTGCCG<br>CCAGAACACAGCTGAAGCTTCGAGGGGCTCGCATCTCTCCTTCACGCGGCCCGCCGCC<br>CTACCTGAGGCCGCCATCCACGCCGGTTGAGTCGCGTTCTGCCGCCTCCCGCCTGTG<br>GTGCCTCCTGAACTGCGTCCGCCGTCTAGGTAAGTTTAAAGCTCAGGTCGAGACCGG<br>GCCTTTGTCCGGCGCTCCCTTGGAGCCTACCTAGACTCAGCCGGCTCTCCACGCMG<br>CCTGACCCTGCTTGCTCAACTCTACGTCTTTGTTTCGTTTTCTGTTCTGCGCCGTTACA<br>GATCCAAGCTGTGACCGGCGCCTACTCTAGAGCTAGCGAATTgccgccaccATGGTGA<br>GCAAGGGCGAGGAGCTGTTCACCGGGGTGGTGCCCATCCTGGTCGAGCTGGACGGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttcactgcattctagttgtggtttgtcc<br>aaactcatcaatgtatcttatGTAGTACTCTCTATAGGCCATTGGAACAGAAGCATCTGGCTTA<br>AAATAATCTCAGCACCAAAAACGGTCTAACTATGGTCTCCACAACATAACCCGATGG<br>TTCTCATATTTTAGATGCTTGATGCACAAGTTGAACTGGCTAACAATTCAGACTTCAG<br>GACTTGACTCCCCTGGGAATCTGCAGTTGTTTCCCTCCCCTTGAGTGAGACTGACTGT<br>TGGGAGTAGAATAACCGCATGCTCTGGGTCAGAATGCCTGGCCCTTCAGAGTAACGG<br>GCAGCCATGATCGCTGAGCTCCTACTGTGAGGCACATACTTCGCCACACTAACACAT<br>GGAATCCTTGCAAGCTCCTTACATAATCAGTATTTTATGCACTTTGCAAATGAGAATA<br>CTAAGGCTCAGAAGAGGCAAGCTCCTCTCCCACTGTTAAACAGCTAGTGATGAACAG<br>AGCTGGG (SEQ ID NO: 225) | 2541 |
| pARBI-621:<br>chr3_3_Exo<br>genous_11<br>4 | ACTCCCCTGGGAATCTGCAGTTGTTTCCCTCCCCTTGAGTGAGACTGACTGTTGGGA<br>GTAGAATAACCGCATGCTCTGGGTCAGAATGCCTGGCCCTTCAGAGTAACGGCAGC<br>CATGATCGCTGAGCTCCTACTGTGAGGCACATACTTCGCCACACTAACACATGGAAT<br>CCTTGCAAGCTCCTTACATAATCAGTATTTTATGCACTTTGCAAATGAGAATACTAAG<br>GCTCAGAAGAGGCAAGCTCCTCTCCCACTGTTAAACAGCTAGTGATGAACAGAGCT<br>GGGACCTAAACTTGTCTGATTTCCCACACTGCTGCTCCATCAGATTGTTTGCCAGGTT<br>AAGGATTCATGCCAGGACCTTAAATCCCTCTGAATGACAGAGCTAACCTAAAGGGC<br>ACCTTGATTTCAGGTTTTGTTCCCAAACCTATGACTGTGGCCTGGCCACGTtgacgactg | 2541 |

TABLE 5-continued

CONSTRUCTS USED FOR EVALUATION OF PREDICTED LOCI

| Construct name | Sequence | Length |
|---|---|---|
| | tgccttctagttgccagccatctgttgtttgccctccccgtgccttccttgaccctggaaggtgccactcccact<br>gtcctttcctaataaaatgaggaaattgcatcgcattgtctgagtaggtgtcattctattctgggggtggggtg<br>gggcaggacagcaagggggaggattgggaagacaatagcaggcatgctgggatgcggtgggctctatggG<br>GATCTGCGATCGCTCCGGTGCCCGTCAGTGGGCAGAGCGCACATCGCCCACAGTCC<br>CCGAGAAGTTGGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcatttttttcactgcattctagttg<br>tggtttgtccaaactcatcaatgtatcttatAATGAAGACCCGGTTGGTTCTAGCTTCACAATGA<br>GCTCATTGGCATTGTCCCCACAACCACCACCCCCTCTCCACCTCTGATCATCCACTATC<br>ATTTCTATATGGCCTTTGCCAGGCTTGTCCTCATATCAAAGTTCTGCCCCTCTATGTTT<br>AAATGCATAAGCTTGACAAATGTTTTCATTTGAGAAGGCAAGCTGCCTCCCCGTGCT<br>TGGTCTAATGTGAGCTTGGTAGAGTGACACTGCTGGATTCAGTTTTAGTCATCAACA<br>CTTCCAGCTGATGCTGATCTGAGTAATTGTCCTATTTAGACTCTGACAGGTGAAAGTC<br>ATAGATTCAGGAAACGGAGACTCCCCTCACCCTGCTATGAAGGGGAGTTTGAGAGG<br>GTTGGGCAGCTCTTCCCGGCAGTGGCAGGCAGTGTGGGGACACACGTATGGATAAA<br>TTGTTAATGCTCTT (SEQ ID NO: 226) | |
| pARBI-622:<br>chr3:1865_<br>Exogenous_<br>109 | CTGCAGGTGGCAGACTTACTCATTCTCATGCTTCAGCTCCAGGGGTTCCCCTGTATGA<br>GTCTTCTCTGCCCGCTCCCACACCCCAGGTAGCATTGCCCCTGCTTGCTTTGTGCCCT<br>CACTGTCTCCACATATATACACATCTCTTACAATAATATTAAATACCAGCCAACATTTA<br>TATAGTACTTCTTATGTACCAAGTACTGTTGTCTATCTATCTATCATCTATCTATC<br>TATGTACACACACACTCATATTATCTTCACAATGCTATGAAATAGGTATTATTGCTGT<br>CCATTTTACAGATGGGGAAACCAATCTATAATTGGTTTAGTGAGATTTACTGAGCAT<br>ATCTACAGGTATTTGTCCTTGGTTATAGGAAACCAATCTGTCACTGGTTTCCCCTTCT<br>GTAAAATAAGTTAAATAATTTGCTTAAGCTCACTCAGATAGTtgacgactgtgccttctagtt<br>gccagccatctgttgtttgccctccccgtgccttccttgaccctggaaggtgccactcccactgtcctttcctaa<br>taaaatgaggaaattgcatcgcattgtctgagtaggtgtcattctattctgggggtggggtgggcaggacag<br>caaggggaggattgggaagacaatagcaggcatgctgggatgcggtgggctctatggGGATCTGCGA<br>TCGCTCCGGTGCCCGTCAGTGGGCAGAGCGCACATCGCCCACAGTCCCCGAGAAGT<br>TGGGGGGAGGGGTCGGCAATTGAACGGGTGCCTAGAGAAGGTGGCGCGGGGTAA<br>ACTGGGAAAGTGATGTCGTGTACTGGCTCCGCCTTMCCCGAGGGTGGGGGAGAA<br>CCGTATATAAGTGCAGTAGTCGCCGTGAACGTTCTTTTTCGCAACGGGTTTGCCGCC<br>AGAACACAGCTGAAGCTTCGAGGGGCTCGCATCTCTCCTTCACGCGCCCGCCGCCCT<br>ACCTGAGGCCGCCATCCACGCCGGTTGAGTCGCGTTCTGCCGCCTCCCGCCTGTGGT<br>GCCTCCTGAACTGCGTCCGCCGTCTAGGTAAGTTTAAAGCTCAGGTCGAGACCGGG<br>CCTTTGTCCGGCGCTCCCTTGGAGCCTACCTAGACTCAGCCGGCTCTCCACGCTTTGC<br>CTGACCCTGCTTGCTCAACTCTACGTCTTTGMCGTTTTCTGTTCTGCGCCGTTACAG<br>ATCCAAGCTGTGACCGGCGCCTACTCTAGAGCTAGCGAATTgccgccaccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatGTGTGGTTGAGTCATAATCTGAGCTACTCTCTGGCCCAAACT<br>GCTTATTGTAACCACCACATCATATGGCCACTTCAGCACCAGTCACACCTCATTTTAC<br>TTGTTGATGTCTCAGTTTTCCCCTCTATTCTGCGGGCTACTTGAGAAGACTTCTGTCTT | 2541 |

TABLE 5-continued

CONSTRUCTS USED FOR EVALUATION OF PREDICTED LOCI

| Construct name | Sequence | Length |
| --- | --- | --- |
| | CTTCCTCTAGGTATCTCTGTGCTTGACTCAGTATCGAGACCATAGGTGTGTGGGTGG<br>GGTTAATCCACACTTGCTGAACACATGTGTCCGTGCCCAATGTCCCTGTGCATAGTG<br>GCTACTTCCCATGGTTCACACGCATCTTCCATGGCTCTTGTTTCTTCCATTCACCCATCC<br>CATGTCCCTGGCCCTGTTCTCAGTGCTGAGGATGGAACCTCATTGCTGCTGCTTCCAG<br>CCCTGGCCCTGCCCCTGTTTGGGGCTCAGTGCTTCATCCCGTGGAGCTCAAGGGGTG<br>CTG (SEQ ID NO: 227) | |
| pARBI-623:<br>chr3:1865_<br>Exogenous_<br>110 | CTTCTCATCCTCACACCCATTCATTTCTTAGTTTCCCATACTCTGACTTCTACTACCCCA<br>AGTTCATAAAGACCTCATGAACACAACCTGGAGAACGCCCTCAGCCTCATCTCACCT<br>CCCTGCAACACATGGCTCACTTGTCTGCTTCTTCCTTCTTAGAGTCCTCTCTCTGGTTG<br>ACCTGTCAAAGATGGGATTCTCCTGTTAACGACCCTGACTCCTTTGTCTCCTTCTACA<br>AGATAATGCACTGACTTTCCAAATGTACTAACTAGTATGATCATCACTGTCTACTGT<br>TGCATCGAACCACTACTAACCTCAATAGGGAAGGCACCAGGTTCAAGAGGCCAAAG<br>AAGAGACCCAGAGCCAGCAAATGAGACATGGGGTTTTATGAGGGGCTCACATAGA<br>GGGGAGAGAGTCCAGTGGCAGTGGGCTGGGCAGGAGAACCACCTTACtgacgactgtg<br>ccttctagttgccagccatctgttgtttgcccctccccgtgccttccttgaccctggaaggtgccactcccactgt<br>cctttcctaataaaatgaggaaattgcatcgcattgtctgagtaggtgtcattctattctgggggtgggtggg<br>gcaggacagcaaggggaggattgggaagacaatagcaggcatgctggggatgcggtgggctctatggGG<br>ATCTGCGATCGCTCCGGTGCCCGTCAGTGGGCAGAGCGCACATCGCCCACAGTCCCC<br>GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcattttttttcactgcattctagttgtggtt<br>tgtccaaactcatcaatgtatcttatACGGTGGTCCAGTGGTGGGAGGCTGGAAAAGAGATCT<br>GTCTTGCCTACAGTTCAGTGGTGGCGGGTTGGGCAGGAAAACCACAACTGCCTGCA<br>AACATCATGCAGTTTACATAACATTGTCACTTAGCAGCCTCCCCTAACGACCTCCACC<br>TGGCAATCTTCATTTTAACCCAAAACTCAAGGCCTCAATCCCCTGTATGGACCATGTTT<br>CATGGGACAGGCCAGGGGCTCAGAAGTTTATCATAGATAAGGAATGAATCTCCGGG<br>TTGGCCACTCCTGGATTCCCTAGCTTGGAACACACATTCAAGTGTATCTGCCATTCTG<br>AGTGTATTCTTCAATTATTGCTGTCAGGTGTGTTGACCCTCTATCTACATAAGTATTTC<br>TCAAACCAGGGCCCCTACGATCAGCATCAGCATCACCTGGGGTATATGTGAAAAATGC<br>AGCTCCTGGACC (SEQ ID NO: 228) | 2541 |
| pARBI-624:<br>chr3:1865_<br>Exogenous_<br>111 | GGGCCAAGCAAGCTCTGAGACAAGCTGTCTCACCTCCTCATCTCCTGAGCACAACTC<br>ACCCACAGCTCTGCCCTCGCCTCCACCTACATCATGCCCTTCCTGCATGCCAACTTCCCT<br>CTGAGGTTCCCTTCACCCACTTACAACCACAGCCTCCTTCCGGACCTCCCCTACACGA<br>TGAACAGTCTGCCAGTTAATATACATCAAGCTGCCACCATGAAACAGCTCGGAAAGC<br>CCCATTTGTTCTCAATAGCATTCCAGCTAGAAAGACCATCCACCACCCATGGCCACTG<br>AAGAAGGTCCTCCCCTGAGTGCCAGGCAGTGGGGCTCCTAACTCTGGGCCCCAATT<br>AGCTTAGCTTGGGGGAGCAAAGGACAGGAGCACTGTTCACCCAGTTGGACTAACAG<br>CTCCACACTGTGCCTAATAGGAACCTCCTTCTCACAGGTGGCACCTTTGtgacgactgtg<br>ccttctagttgccagccatctgttgtttgcccctccccgtgccttccttgaccctggaaggtgccactcccactgt<br>cctttcctaataaaatgaggaaattgcatcgcattgtctgagtaggtgtcattctattctgggggtgggtggg<br>gcaggacagcaaggggaggattgggaagacaatagcaggcatgctggggatgcggtgggctctatggGG<br>ATCTGCGATCGCTCCGGTGCCCGTCAGTGGGCAGAGCGCACATCGCCCACAGTCCCC<br>GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG | 2541 |

TABLE 5-continued

CONSTRUCTS USED FOR EVALUATION OF PREDICTED LOCI

| Construct name | Sequence | Length |
| --- | --- | --- |
| | CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGCCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcatttttttcactgcattctagttgtggtt<br>tgtccaaactcatcaatgtatcttatTGAATCAGGGTCTGTCCTGAGCCACCCTCCCTTGGAGA<br>GATCTGAGCACTGAGAACCACAGAGCCTGGGACACCAGCACAGGGTTTGAAAAACT<br>CCACTCCCAGTCAGCTGCGGTGGCTCATGCCTGTAATCCCAGCACTTTGGGAGGCTG<br>AGGTGGGTGGATCACAAGGTCAGGAGTTCGAGACAGCTTGACCAGCATGGTAAAA<br>CCCCATCTCTACTAAAAGTACAAAAATTAGCCAGGCATGGTGTTGGGCACCTATAAT<br>CCCAGCTACTCGGGAGGCTGAGGCAGGGGAATTGTTTGAACCTGGGAGCTGGAGG<br>TTGCAGTGAGCCGAGATCGCACCACTGCACTCCAGCCTGGGCGGCTGAGCGAGATT<br>CTGTCTCAAAAAAATGGGAAAAACATCATTCCCATGTGTGTCCTGGTTGCTTGTCTCT<br>TTCAAAGTACTGCATACT (SEQ ID NO: 229) | |
| pARBI-625:<br>chr8_1_Exo<br>genous_11<br>5 | CCACATCATGGACCAGAAGCCACTTGGTCTGGTTGTGAGGATGACGGAACCTTGCC<br>CGAGGGAAATGGGCAATGAACAGGAGCCTGTTTGTTTCTCCTTCCAGCTCCTGACCTG<br>TCTAGCTCCTGACCCTCTCAGTGTCATTCTTGCTCACCCCTGGCCCTGCTCCCTGGATA<br>TGCAGACAGGATGGGCTTCTTCCCTTTAGACCTTCACTTTGCTCTTTTGGACTCCTCTT<br>CTGGCCTTGCCTTCCCCTGGTGTCATCTGCTGGCTCCCTGCCTGATACTGCCACACTG<br>GTCATGCTGGCCTCCTGGCCTTTGGTGACACCGCATCAGCAGGCTCCTGCTTCCCTGT<br>CAAGGGATACAAGCCAGCACCGGTCTTTCGCCACAAGGTATGTGTGTAAAGAUGC<br>TTCCTGTACTTGGTGTCCACAGGATTTTAAAGAACTCCTGGCCCACTtgacgactgtgccttt<br>ctagttgccagccatctgttgtttgccctccccgtgccttccttgaccctggaaggtgccactccactgtccttt<br>tcctaataaaatgaggaaattgcatcgcattgtctgagtaggtgtcattctattctgggggtggggtggggca<br>ggacagcaaggggaggattgggaagacaatagcaggcatgctgggatgcggtgggctctatggGGATC<br>TGCGATCGCTCCGGTGCCCGTCAGTGGGCAGAGCGCACATCGCCCACAGTCCCCGA<br>GAAGTTGGGGGGAGGGGTCGGCAATTGAACGGGTGCCTAGAGAAGGTGGCGCGG<br>GGTAAACTGGGAAAGTGATGTCGTGTACTGGCTCCGCCTTMCCCGAGGGTGGGG<br>GAGAACCGTATATAAGTGCAGTAGTCGCCGTGAACGTTCTTTTTCGCAACGGGTTTG<br>CCGCCAGAACACAGCTGAAGCTTCGAGGGGCTCGCATCTCTCCTTCACGCGCCCGCC<br>GCCCTACCTGAGGCCGCCATCCACGCCGGTTGAGTCGCGTTCTGCCGCCTCCCGCCT<br>GTGGTGCCTCCTGAACTGCGTCCGCCGTCTAGGTAAGTTTAAAGCTCAGGTCGAGAC<br>CGGGCCTTTGTCCGGCGCTCCCTTGGAGCCTACCTAGACTCAGCCGGCTCTCCACGC<br>TTTGCCTGACCCTGCTTGCTCAACTCTACGTCTTTGTTTCGTTTTCTGTTCTGCCCGT<br>TACAGATCCAAGCTGTGACCGGCGCCTACTCTAGAGCTAGCGAATTgccgccaccATGG<br>TGAGCAAGGGCGAGGAGCTGTTCACCGGGGTGGTGCCCATCCTGGTCGAGCTGGA<br>CGGCGACGTAAACGGCCACAAGTTCAGCGTGTCCGGCGAGGGCGAGGGCGATGCC<br>ACCTACGGCAAGCTGACCCTGAAGTTCATCTGCACCACCGGCAAGCTGCCCGTGCC<br>TGGCCCACCCTCGTGACCACCCTGACCTACGGCGTGCAGTGCTTCAGCCGCTACCCC<br>GACCACATGAAGCAGCACGACTTCTTCAAGTCCGCCATGCCCGAAGGCTACGTCCAG<br>GAGCGCACCATCTTCTTCAAGGACGACGGCAACTACAAGACCCGCGCCGAGGTGAA<br>GTTCGAGGGCGACACCCTGGTGAACCGCATCGAGCTGAAGGGCATCGACTTCAAGG<br>AGGACGGCAACATCCTGGGGCACAAGCTGGAGTACAACTACAACAGCCACAACGTC<br>TATATCATGGCCGACAAGCAGAAGAACGGCATCAAGGTGAACTTCAAGATCCGCCA<br>CAACATCGAGGACGGCAGCGTGCAGCTCGCCGACCACTACCAGCAGAACACCCCCA<br>TCGGCGACGCCCCCGTGCTGCTGCCCGACAACCACTACCTGAGCACCCAGTCCAAGC<br>TGAGCAAAGACCCCAACGAGAAGCGCGATCACATGGTCCTGCTGGAGTTCGTGACC<br>GCCGCCGGGATCACTCTCGGCATGGACGAGCTGTACAAatgattgtttattgcagcttataat<br>ggttacaaataaagcaatagcatcacaaatttcacaaataaagcatttttttcactgcattctagttgtggtttgt<br>ccaaactcatcaatgtatcttatCGGAACTCTACGCTTGAAACAGAAACATTCTCAAAACA<br>CCTCTGGTATTGGCCCATTTCTCTATTACTGTTTCTTGTGGTTTCATACTGAGGTTTTT<br>GGTGCATTGCAATTGCCCTGGAGTTTATTTTTAGTAATAAAGACAGAGTTCAATTAAT<br>GTCAAAACATGAGGGTAATTGCAGAGGAAGGATTAGTAAGTCTAGGGGAAAATGT<br>GCCCAACTTTTTTTCTTCTGATAACATCTTTCACTGATCATACACCGTCACACCCACAG<br>ACACGGAGCTTCCTCCGTGATGTCTGCAATGCACTAGGCCCAGTCGGGAGCAGTG<br>GCTGCGCCACCACCTGAAAACGAAAGCATTTCTGAGTCTCTTTCAGTCCAGCTCATCT<br>AGCAGCCAGCCACACAGGTGACCACCCACCGTAGCTGTCACTATGGGTGATGATTAT<br>CATTATGG (SEQ ID NO: 230) | 2541 |
| pARBI-626:<br>chr8_2_Exo<br>genous_11<br>6 | AGGATCTTTCTCTCTACAGTGCCTCTTGTGGGACGGGTTCTGCTGATGGGGGCTGTG<br>TTTGGGATCTCGCCTGGAAACACGATCTCTCCAACTTTCCCTGGGAGCAGAGCCTTG<br>GGTCTCACTGAACCCACCTCCCCAGCACCTTGTGTGGTGACTGGCAGGAGGTAGCCA<br>TTCCCTCCTGTCCTCTCTGCCCTTGTCCACTTTCCTGTTATGAGTCAGTTGCTGAGATA<br>GGCTATGAGGAGTTAACAGAGTGGATAAAAAGAGCTTTGTCCTTCTTTAAAGCCTT<br>CAAAATATACAGATGTATTAGTCAGGGCTTTCCAGAGAAACAGGACCAATAGAACA<br>TGAAGATAGATGCGTATCCATGTCTATATCAATATCTACCTTGATATTTATATCTATAT<br>CTAGGAGATTTATTTATTATAAGGTATTGGCTCATGCAATTATGGACCtgacgactgtgcc | 2541 |

TABLE 5-continued

CONSTRUCTS USED FOR EVALUATION OF PREDICTED LOCI

| Construct name | Sequence | Length |
|---|---|---|
| | ttctagttgccagccatctgttgtttgcccctcccccgtgccttccttgaccctggaaggtgccactcccactgtcc<br>tttcctaataaaatgaggaaattgcatcgcattgtctgagtaggtgtcattctattctgggggtggggtggggc<br>aggacagcaaggggaggattgggaagacaatagcaggcatgctggggatgcggtgggctctatggGGAT<br>CTGCGATCGCTCCGGTGCCCGTCAGTGGGCAGAGCGCACATCGCCCACAGTCCCG<br>AGAAGTTGGGGGGAGGGGTCGGCAATTGAACGGGTGCCTAGAGAAGGTGGCGCG<br>GGGTAAACTGGGAAAGTGATGTCGTGTACTGGCTCCGCCTTTTTCCCGAGGGTGGG<br>GGAGAACCGTATATAAGTGCAGTAGTCGCCGTGAACGTTCTTTTTCGCAACGGGTTT<br>GCCGCCAGAACACAGCTGAAGCTTCGAGGGGCTCGCATCTCTCCTTCACGCGCCCGC<br>CGCCCTACCTGAGGCCGCCATCCACGCCGGTTGAGTCGCGTTCTGCCGCCTCCCGCC<br>TGTGGTGCCTCCTGAACTGCGTCCGCCGTCTAGGTAAGTTTAAAGCTCAGGTCGAGA<br>CCGGGCCTTTGTCCGGCGCTCCCTTGGAGCCTACCTAGACTCAGCCGGCTCTCCACG<br>CTTTGCCTGACCCTGCTTGCTCAACTCTACGTCTTTGTTTCGTTTTCTGTTCTGCGCCG<br>TTACAGATCCAAGCTGTGACCGGCGCCTACTCTAGAGCTAGCGAATTgccgccaccATG<br>GTGAGCAAGGGCGAGGAGCTGTTCACCGGGGTGGTGCCCATCCTGGTCGAGCTGG<br>ACGGCGACGTAAACGGCCACAAGTTCAGCGTGTCCGGCGAGGGCGAGGGCGATGC<br>CACCTACGGCAAGCTGACCCTGAAGTTCATCTGCACCACCGGCAAGCTGCCCGTGCC<br>CTGGCCCACCCTCGTGACCACCCTGACCTACGGCGTGCAGTGCTTCAGCCGCTACCC<br>CGACCACATGAAGCAGCACGACTTCTTCAAGTCCGCCATGCCCGAAGGCTACGTCCA<br>GGAGCGCACCATCTTCTTCAAGGACGACGGCAACTACAAGACCCGCGCCGAGGTGA<br>AGTTCGAGGGCGACACCCTGGTGAACCGCATCGAGCTGAAGGGCATCGACTTCAAG<br>GAGGACGGCAACATCCTGGGGCACAAGCTGGAGTACAACTACAACAGCCACAACGT<br>CTATATCATGGCCGACAAGCAGAAGAACGGCATCAAGGTGAACTTCAAGATCCGCC<br>ACAACATCGAGGACGGCAGCGTGCAGCTCGCCGACCACTACCAGCAGAACACCCCC<br>ATCGGCGACGGCCCCGTGCTGCTGCCCGACAACCACTACCTGAGCACCCAGTCCAA<br>GCTGAGCAAAGACCCCAACGAGAAGCGCGATCACATGGTCCTGCTGGAGTTCGTGA<br>CCGCCGCCGGGATCACTCTCGGCATGGACGAGCTGTACAAatgattgtttattgcagcttata<br>atggttacaaataaagcaatagcatcacaaatttcacaaataaagcatttttttcactgcattctagttgtggttt<br>gtccaaactcatcaatgtatcttatCAGAGGGGTCCTGTGATTTGCCACCTGCAGGCTGGAGA<br>CCTAGGAAACAGCTGTCGTGTCACAAAGGGCAGAGGGCTGGAGAACCTGTAGTGT<br>AGATTCCAGTCCAGATTCGAAGGCCTGAGGACCAGGAATGCCAAGGGCAGGAGAA<br>GATCGATGTCCCAGAACAAGCAATCAGGCAGAGATGAAATTCAACCTTCCTGTGCCT<br>TTCTGTTCTATTCAGGCCTTCAGTGGGTTGAATGAGGCCCAACCCACATTGAAGAGG<br>ACCATCTGCTTTACTCAGTCTCCTGGTTGAAGTGATAATCTCATCTGGACATACTCAG<br>AAATGCTGTTTAACCAGCTCTCTGGAAATCCTGTGGCCCAGTCAAGTTGACACACAA<br>AATTAACCATCACACTGCAGAGACACAGTCTATCCCAATACCTGTATTTACTGGGTAA<br>CGTGCATCTCAGCTC (SEQ ID NO: 231) | |
| pARBI-627:<br>chr8_3_Exo<br>genous_11<br>7 | TAATAATGACTCTGCTGGTAATTTGTGTCCTTCTGCTTGGAACTGTTTCCTTTTTAGTT<br>TGGTCACCCTCCCAGAGCTGGTTTCAATGGGGGCATACCCATTATGGGATGCAGGG<br>CATCCTGCATCCTGAGGAATTTTTTTTCCTCCAAAAATGAAACCTTGAAATGAGGACA<br>TTGTCCTGTCCACGGACTGCACAACAACACTGAGCCTCAAGGACTCATACTGGCATT<br>TTTCTTCTTTTGCAGAGTGTGGGCACCCTGGCTTCAAGCTCACGAGAAACCAGGTCG<br>GGATTTAAACAATGTTGGGTTAAAGCAAAGTTTCATAAAGACAGAATCAAGAAAAA<br>AAGAAAGAGAAACCAATCTAAGTGCCATCCTCCCTGAGTTGCATCTTACCTGAGTCT<br>TCAGCCGCCGCCCCCTGCTGCTGTGGGAGGAAACGGGAAAGTGACTGGCCTgacgact<br>gtgccttctagttgccagccatctgttgtttgcccctcccccgtgccttccttgaccctggaaggtgccactcccac<br>tgtccttttcctaataaaatgaggaaattgcatcgcattgtctgagtaggtgtcattctattctgggggtggggtg<br>gggcaggacagcaaggggaggattgggaagacaatagcaggcatgctggggatgcggtgggctctatggG<br>GATCTGCGATCGCTCCGGTGCCCGTCAGTGGGCAGAGCGCACATCGCCCACAGTCC<br>CCGAGAAGTTGGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcattttttttcactgcattctagttg<br>tggtttgtccaaactcatcaatgtatcttatATGGGACAGGGGTCGGGGGTGTGAGGGTTAGT<br>GGTAGCAGGGAGGTAGCACTTCTGTGAAGCCGGAAAGGAGACCTGAACCTGGCTC<br>TCTGCTTTGCTGCTTGCCAGCCCTCTGGCTGGGAAGAAGGCTCTTGGCTCTTGTGAG | 2541 |

TABLE 5-continued

CONSTRUCTS USED FOR EVALUATION OF PREDICTED LOCI

| Construct name | Sequence | Length |
|---|---|---|
| | CCTCGGTTTCCTCTGCAGAGTGGCCTGTTCTGAGGACAGGCTGACATTGCTGTCCAT<br>CAGTCTTCCAGGACCCTGAGGATTTCAGCTCTACCCATGGGCACTGAACTGGAACAT<br>TCACTGGTCATTTGCTTTCGTTTTTTTTTTTGTTTGTTTGTTTTTTGATACAGAGTTTC<br>ACTCTTGTTGCCTAGGGTGGAGTACAATGGCGTGATCTCAGCTCACCACAAGCTCTG<br>CCTCCCGGGGTCAAGCGATTCTCCCCAGTAGCTGAGATTACAGGCATGCGCCACCAC<br>GTCCGGCTAATTTTGTA (SEQ ID NO: 232) | |
| pARBI-628:<br>chr9_1_Exo<br>genous_11<br>8 | AAGTCAACAACAGGCTCCAGAAAAAAATGGAAATATAAATGGTCCCCAATTTGGCA<br>TTTTGGAATTTGAGGCTTATATAGTATGAGCAAAATAAACTCCTCCTGCTTCTATGAA<br>TTCTTTGCACTTTTTCTCTATAATTCCTTATCAAGCAATGGGTTTGTCTGTTAACCAAG<br>ACTATACATAAAATGTATTCCCGTAGTTCCTTTTATTACATTTTTTCTTTGTTGTTACTA<br>GTGGAGAAGCTAACAAGAGCAGAATTTCCTGCCCAACCGTAGCAAATACAGAAAAT<br>CAAAAAGAGAAGCTTTGATACAGCCAGTGTAGATACAGCTAGGACGTCATGAATCA<br>GAGCTCCCACACACGATGATAATGGAAACATCTTATCCATATCTGATTTGCTCACATA<br>TAGTTATTTAGACAACAAATTTTACATTCCTGGATAGGGAGCCTCCGtgacgactgtgcct<br>tctagttgccagccatctgttgtttgccctccccgtgccttccttgaccctggaaggtgccactcccactgtcct<br>ttcctaataaaatgaggaaattgcatcgcattgtctgagtaggtgtcattctattctgggggggtggggtgggca<br>ggacagcaaggggaggattgggaagacaatagcaggcatgctggggatgcggtgggctctatggGGATC<br>TGCGATCGCTCCGGTGCCCGTCAGTGGGCAGAGCGCACATCGCCCACAGTCCCCGA<br>GAAGTTGGGGGGAGGGGTCGGCAATTGAACGGGTGCCTAGAGAAGGTGGCGCGG<br>GGTAAACTGGGAAAGTGATGTCGTGTACTGGCTCCGCCTTTTTCCCGAGGGTGGGG<br>GAGAACCGTATATAAGTGCAGTAGTCGCCGTGAACGTTCTTTTTCGCAACGGGTTTG<br>CCGCCAGAACACAGCTGAAGCTTCGAGGGGCTCGCATCTCTCCTTCACGCGCCCGCC<br>GCCCTACCTGAGGCCGCCATCCACGCCGGTTGAGTCGCGTTCTGCCGCCTCCCGCCT<br>GTGGTGCCTCCTGAACTGCGTCCGCCGTCTAGGTAAGTTTAAAGCTCAGGTCGAGAC<br>CGGGCCTTTGTCCGGCGCTCCCTTGGAGCCTACCTAGACTCAGCCGGCTCTCCACGC<br>TTTGCCTGACCCTGCTTGCTCAACTCTACGTCTTTGTTTCGTTTTCTGTTCTGCGCCGT<br>TACAGATCCAAGCTGTGACCGGCGCCTACTCTAGAGCTAGCGAATTgccgccaccATGG<br>TGAGCAAGGGCGAGGAGCTGTTCACCGGGGTGGTGCCCATCCTGGTCGAGCTGGA<br>CGGCGACGTAAACGGCCACAAGTTCAGCGTGTCCGGCGAGGGCGAGGGCGATGCC<br>ACCTACGGCAAGCTGACCCTGAAGTTCATCTGCACCACCGGCAAGCTGCCCGTGCCC<br>TGGCCCACCCTCGTGACCACCCTGACCTACGGCGTGCAGTGCTTCAGCCGCTACCCC<br>GACCACATGAAGCAGCACGACTTCTTCAAGTCCGCCATGCCCGAAGGCTACGTCCAG<br>GAGCGCACCATCTTCTTCAAGGACGACGGCAACTACAAGACCCGCGCCGAGGTGAA<br>GTTCGAGGGCGACACCCTGGTGAACCGCATCGAGCTGAAGGGCATCGACTTCAAGG<br>AGGACGGCAACATCCTGGGGCACAAGCTGGAGTACAACTACAACAGCCACAACGTC<br>TATATCATGGCCGACAAGCAGAAGAACGGCATCAAGGTGAACTTCAAGATCCGCCA<br>CAACATCGAGGACGGCAGCGTGCAGCTCGCCGACCACTACCAGCAGAACACCCCCA<br>TCGGCGACGGCCCCGTGCTGCTGCCCGACAACCACTACCTGAGCACCCAGTCCAAGC<br>TGAGCAAAGACCCCAACGAGAAGCGCGATCACATGGTCCTGCTGGAGTTCGTGACC<br>GCCGCCGGGATCACTCTCGGCATGGACGAGCTGTACAAgatgatttgtttattgcagcttataat<br>ggttacaaataaagcaatagcatcacaaatttcacaaataaagcatttttttcactgcattctagttgtggtttgt<br>ccaaactcatcaatgtatcttatATTTGATTTCAATCTCATAGTCCAGGTAGGTGTAAAATGA<br>CTGCCAAGCCAGCAGACATAAATCTGTATTATCTCATTTTCATCACAGTCTCTGCATT<br>GGGAAAAAAATGTGAGTGAAAAGACATTTCTCCCACCTTGTTAAGTACACAATTAC<br>ATAGTTTAAAGAAGATAAGAATTTCAAATTGTTAGAATGATATCATTATTCAAATGAT<br>TCCCTGAGAACTTCAAGTATTCCCCTTCCCCCAAATGTAGGCAGGGCAAAATAGAAC<br>CAGTAGGAATGAAAAATGTTAATTGTTTCAGGTTCTGTAATTTTGGGTTTAATGACTC<br>AGGCTATGTGCTACTGAGTAAAATACTCATCTGGAGAAAAAGACTGTTGCATGACAT<br>ATTTCTGATTAAGGACAATTTAAACTAATTCTAAGAAAACTCTTACATACTGCACATG<br>CCATAAA (SEQ ID NO: 233) | 2541 |
| pARBI-629:<br>chr9_2_Exo<br>genous_11<br>9 | GATTAGGTCTGGAATAAGATTGCACCATGACTAAAATGACTTCTTTAGCCAATGACA<br>TTCCTGAAGATTGGATCAGAGTAAAGTTAAACTAACCTACTCAAGGAAGACTTTCCT<br>AAATCAGCCCCTTTGCTGTATAATTTAGTATGGAGAGCTGATTGTGGGTTTTTCTTGT<br>TTCATTGTTTAATACATAGAGGTTTCACATTTCATTTTGAAACAGAAAGAGGGACTG<br>GAAGAGATAAGTTAGTATGAGTGAGGAAAAGATTAGAAGGTAGAGATAGGATCGC<br>AATGCTGTTATCACCTTTGCTTTATTGATAATCTCAGGAAGGACTAGACTGCTAAGAA<br>AGAGGAGCCCAGATTGGAATAAAAGAGACGATGCCAGGATCAGCCTGTGAGAGGA<br>TGTCTCACTTAGTACACCTCAAGGATCATGTCAGCTGAGCATCTATACCCCGctgacga<br>ctgtgccttctagttgccagccatctgttgtttgccctccccgtgccttccttgaccctggaaggtgccactccc<br>actgtcctttcctaataaaatgaggaaattgcatcgcattgtctgagtaggtgtcattctattctgggggggtgggg<br>tggggcaggacagcaaggggaggattgggaagacaatagcaggcatgctggggatgcggtgggctctatg<br>gGGATCTGCGATCGCTCCGGTGCCCGTCAGTGGGCAGAGCGCACATCGCCCACAGT<br>CCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG | 2541 |

TABLE 5-continued

CONSTRUCTS USED FOR EVALUATION OF PREDICTED LOCI

| Construct name | Sequence | Length |
|---|---|---|
| | CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggtttacaaataaagcaatagcatcacaaatttcacaaataaagcattttttttcactgcattctag<br>ttgtggtttgtccaaactcatcaatgtatcttatGTGATGAATATTGCATACAGACTCTGCCTTCAA<br>GTCATCCCCCATTCGACAAGCATTTATTTAAGGTTCTTACATTCCAGGACTTGTACTA<br>GATGCTAGAAACAAACAGATAAGGAAAACGTAGGAAAATGCTTCTCTCAGGAAGCA<br>ATATTGTATATGAGTGGTGAAGAGCTTCAAATCTGGGGCCAAACTGCTGGGTTTGA<br>AATTTGGCTTGGCCACCTACTGGCTGTGAAATCTTGGGCAACTTTCTTAATCACTCTG<br>TGCCTCAGTTTCTTCATCTGTAAAATGAAATAGCCATAGTACTTATTACAAATAGGTA<br>ATAATTAGTGAGAATTAATTTGAGTCAATACATAAAAATGACTCAGAATAAAAGACC<br>AGCTAAGAATATATACACACATACTTAGCTACTTATAATCTAGTAGGAAAGATGGGT<br>ATGTTATCAGAGGACTT (SEQ ID NO: 234) | |
| pARB1-630:<br>chr9_3_Exo<br>genous_12<br>0 | CAGATAAAAAAAGCTGAAGCTCAGGGATATTGTCATTTACCCATGAGCTCACAGGCA<br>GGAAGTGGTGAAACTATCATTAAACTACGGTTGGCCTTGTTCTTTTGTGGTTTCATTT<br>CACTAAGCCTCTGACACCCTGACCTCAACTTCCTTCTGTAGATATGTCACCTGGCCTC<br>CTTCAGTCTAAGACACTACACACTGGCCACACACTTTGTCATCCTCATAGACTGACAA<br>CCTGCTCTCACATACCCTGCTTTCTTACTGTGTAGGCTCTCTTTTCTTGCTCAGAATGT<br>CCTTCCCCACTTCTTCATGTGCCAACTCCTAGTCATCCTACAAGAACCACATTCACTTT<br>AAGTTTCTTTTGAAGCCTTTTCAGTGTCCCATACCCTGATCCCATTACCTCTTCTATGT<br>ATGCAGGGCTTGCTTCATGCTTGTGTAAACCCAAGGGCCCTGCtgacgactgtgccttctagtt<br>gccagccatctgttgtttgccctccccgtgccttccttgacccctggaaggtgccactccactgtcctttcctaa<br>taaaatgaggaaattgcatcgcattgtctgagtaggtgtcattctattctgggggtggggtggggcaggacag<br>caaggggggaggattgggaagacaatagcaggcatgctgggtatgcggtgggctctatggGGATCTGCGA<br>TCGCTCCGGTGCCCGTCAGTGGGCAGAGCGCACATCGCCCACAGTCCCCGAGAAGT<br>TGGGGGGAGGGTCGGCAATTGAACGGGTGCCTAGAGAAGGTGGCGCGGGGTAA<br>ACTGGGAAAGTGATGTCGTGTACTGGCTCCGCCTTMCCCGAGGGTGGGGGAGAA<br>CCGTATATAAGTGCAGTAGTCGCCGTGAACGTTCTTTTTCGCAACGGGTTTGCCGCC<br>AGAACACAGCTGAAGCTTCGAGGGGCTCGCATCTCTCCTTCACGCGCCCGCCGCCCT<br>ACCTGAGGCCGCCATCCACGCCGGTTGAGTCGCGTTCTGCCGCCTCCCGCCTGTGGT<br>GCCTCCTGAACTGCGTCCGCCGTCTAGGTAAGTTTAAAGCTCAGGTCGAGACCGGG<br>CCTTTGTCCGGCGCTCCCTTGGAGCTACCTAGACTCAGCCGGCTCTCCACGCTTTGC<br>CTGACCCTGCTTGCTCAACTCTACGTCTTTGMCGTTTTCTGTTCTGCGCCGTTACAG<br>ATCCAAGCTGTGACCGGCGCCTACTCTAGAGCTAGCGAATTgccgccaccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttttcactgcattctagttgtggtttgtcc<br>aaactcatcaatgtatcttatATTTGATTTAACACATTTTAAAATTCTTAACAATTTATGAAAA<br>AGGAAACCCATATGTTCATTCTGCCCTGGACCCTGCAAATTATGCAGCCAATCCTGT<br>GTGTGTTTTTCATGTTGCGTAGACTCTATTACAGTCAGTAACATATTGAGAAAGAGT<br>GTGTGTCTCCTCTGATAGTCTATGAGCTCCTTGAAGCAAGAGGCTTGTCTTAGTCATT<br>GCTGTATCCTCACACCAGACTCTACGGGATGCTCAGGATTCACCTGTTGATCTGTGA<br>GGAAGCCCAAGGCTCAGTTAATGCCCCCACCCTCCTTCCCATAACAGTCTCCTGATTA<br>GGAAACAGTGCTTGACCTCTAGACAATCTGAGTATCCACTCCAGGAAGTGGAACATT<br>GCCTTCCCAATGTTGAAACTGTTAGCACTCAATCATGTTTCAGGAACATATAGAAGG<br>TATGT (SEQ ID NO: 235) | 2541 |
| pARBI-631:<br>chr10_1_Ex<br>ogenous_9<br>0 | TGGACCTTATGCAGGGTAATAAAAACCAACACGTGGGGCCTGTGCTGTAAGGTGGC<br>AGAGGGCGATGACTCACCCCACTCATGCAGGTTGAGTCATTTCAAGGCAGAGTTGT<br>GCCAGTTCAGTACCCAGTAATATTTTCCAGTCGACGAGTATCAGTGAACAGGAGATA<br>ACCAGTCATTTCTAGATTCTGCTCAGAGTCCCAGCTTAGAGGCTCCACCAGCTCAAA<br>GAGACGGGATGGCAAAACAGCCACCTTAATTTCCAGATCATCTGCCAGCTCATCTGC<br>CAGCTGACACACAGCCCATGGCTCCACTATTGCCAGTGCTGTAGCTGCACCAGACCA<br>ATCTGGTTCAACTTTTATGTAACAAAGTTGTGATTTGTTTTTCAGTTGCCCGGGACTC<br>CCAGGTTGAAGATCATGAGCATGCCCTGATGAGCCAAGGCATGCAACCACAGtgacg | 2541 |

TABLE 5-continued

CONSTRUCTS USED FOR EVALUATION OF PREDICTED LOCI

| Construct name | Sequence | Length |
|---|---|---|
| | actgtgccttctagttgccagccatctgttgtttgccctccccgtgccttccttgaccctggaaggtgccactcc cactgtcctttcctaataaaatgaggaaattgcatcgcattgtctgagtaggtgtcattctattctgggggtggg gtggggcaggacagcaaggggaggattgggaagacaatagcaggcatgctggggatgcggtgggctctat ggGGATCTGCGATCGCTCCGGTGCCCGTCAGTGGGCAGAGCGCACATCGCCCACAG TCCCCGAGAAGTTGGGGGGAGGGGTCGGCAATTGAACGGGTGCCTAGAGAAGGTG GCGCGGGGTAAACTGGGAAAGTGATGTCGTGTACTGGCTCCGCCTTTTTCCCGAGG GTGGGGGAGAACCGTATATAAGTGCAGTAGTCGCCGTGAACGTTCTTTTTCGCAAC GGGTTTGCCGCCAGAACACAGCTGAAGCTTCGAGGGGCTCGCATCTCTCCTTCACGC GCCCGCCGCCCTACCTGAGGCCGCCATCCACGCCGGTTGAGTCGCGTTCTGCCGCCT CCCGCCTGTGGTGCCTCCTGAACTGCGTCCGCCGTCTAGGTAAGTTTAAAGCTCAGG TCGAGACCGGGCCTTTGTCCGGCGCTCCCTTGGAGCCTACCTAGACTCAGCCGGCTC TCCACGCTTTGCCTGACCCTGCTTGCTCAACTCTACGTCTTTGTTTCGTTTTCTGTTCT GCGCCGTTACAGATCCAAGCTGTGACCGGCGCCTACTCTAGAGCTAGCGAATTgccgc caccATGGTGAGCAAGGGCGAGGAGCTGTTCACCGGGGTGGTGCCCATCCTGGTCG AGCTGGACGGCGACGTAAACGGCCACAAGTTCAGCGTGTCCGGCGAGGGCGAGGG CGATGCCACCTACGGCAAGCTGACCCTGAAGTTCATCTGCACCACCGGCAAGCTGCC CGTGCCCTGGCCCACCCTCGTGACCACCCTGACCTACGGCGTGCAGTGCTTCAGCCG CTACCCCGACCACATGAAGCAGCACGACTTCTTCAAGTCCGCCATGCCCGAAGGCTA CGTCCAGGAGCGCACCATCTTCTTCAAGGACGACGGCAACTACAAGACCCGCGCCG AGGTGAAGTTCGAGGGCGACACCCTGGTGAACCGCATCGAGCTGAAGGGCATCGA CTTCAAGGAGGACGGCAACATCCTGGGGCACAAGCTGGAGTACAACTACAACAGCC ACAACGTCTATATCATGGCCGACAAGCAGAAGAACGGCATCAAGGTGAACTTCAAG ATCCGCCACAACATCGAGGACGGCAGCGTGCAGCTCGCCGACCACTACCAGCAGAA CACCCCCATCGGCGACGGCCCCGTGCTGCTGCCCGACAACCACTACCTGAGCACCCA GTCCAAGCTGAGCAAAGACCCCAACGAGAAGCGCGATCACATGGTCCTGCTGGAGT TCGTGACCGCCGCCGGGATCACTCTCGGCATGGACGAGCTGTACAAatgattgtttattgc agcttataatggttacaaataaagcaatagcatcacaaatttcacaaataaagcatttttttcactgcattctag ttgtgttttgtccaaactcatcaatgtatcttatGGGAACCTAAGTGCTTGGACTGAGGAGTGGG GACTGAAATAAGAAGCGGACACTGCAGGGCAGGATCAGGATCCAATCAGATCGAG CCCTGGCATCACCTCATGGCAGGATCTAGTCAGATCGTGGCTTTTGACATCACTTCAT TGTGAAATCCAATCAGATCACACCTTATTACCCTATCCTTATAAAACCGGACCTAGCC CCCAGCTCGAGGAGGCACTGCTTTGGGAGTTATCCCAGGTGTTCTTGTTACTAGTTG CAAGGAATAAAATCCTCTTGCTAAATCCTCCTTGGTTGTGCAGATGTTGGCATGGAT GTGGAGAGAAGGGAACACTTACGCTTTGTTGGTGAGGATGTAAATTAGCTCAACTC TGTGATAAACAGTATGGAGAGTTTTCAAAGAACTAAAAATAGAACTTCTACTCAACC CAGCAATCCTATGAGTGCATG (SEQ ID NO: 236) | |
| pARBI-632: chr10_2_Ex ogenous_8 8 | ACATCTAATCCCACACCATGACTAATAAACATGGCATGCTGCAATGGGCATTAATTTA TGGGTAACAGAAGCAGATCCAAGCCTTTTAGCTAATTAAATAAAAATGCACCATACA GCAACCATCCTGCCTGCTTGGGTGTAAAATAGAGAGGAGAAAGATGGCATGCTGGT CATTGAGAGATAATTACCTGCAATTTCAGAGCTGGAATCTAGTGCAACATAAGAAA AATAATAACCTCTCTGGCTGTTAGGATTCTCAGTTCTAGCTGCGAGCAAGGAGCAAA GGCACCCACAGACTTGCCAAAACCTATGTCAGGAATGACGAATAGAAGGCAGAAATC CACATCCCCAGGTGGTAAAATTGTTATCCACCTTCGTCACCTCTTTCCTAATGGAGGA AGTGAGGACAGGCAGCCTTGGAGTCCTACTTGAATGAGGCCTGGACCTTATtgacgac tgtgccttctagttgccagccatctgttgtttgcccctccccgtgccttccttgaccctggaaggtgccactccca ctgtcctttcctaataaaatgaggaaattgcatcgcattgtctgagtaggtgtcattctattctgggggtgggt ggggcaggacagcaaggggaggattgggaagacaatagcaggcatgctggggatgcggtgggctctatgg GGATCTGCGATCGCTCCGGTGCCCGTCAGTGGGCAGAGCGCACATCGCCCACAGTC CCCGAGAAGTTGGGGGGAGGGGTCGGCAATTGAACGGGTGCCTAGAGAAGGTGG CGCGGGGTAAACTGGGAAAGTGATGTCGTGTACTGGCTCCGCCTTTTTCCCGAGGG TGGGGGAGAACCGTATATAAGTGCAGTAGTCGCCGTGAACGTTCTTTTTCGCAACG GGTTTGCCGCCAGAACACAGCTGAAGCTTCGAGGGGCTCGCATCTCTCCTTCACGCG CCCGCCGCCCTACCTGAGGCCGCCATCCACGCCGGTTGAGTCGCGTTCTGCCGCCTC CCGCCTGTGGTGCCTCCTGAACTGCGTCCGCCGTCTAGGTAAGTTTAAAGCTCAGGT CGAGACCGGGCCTTTGTCCGGCGCTCCCTTGGAGCCTACCTAGACTCAGCCGGCTCT CCACGCTTTGCCTGACCCTGCTTGCTCAACTCTACGTCTTTGTTTCGTTTTCTGTTCTG CGCCGTTACAGATCCAAGCTGTGACCGGCGCCTACTCTAGAGCTAGCGAATTgccgcc accATGGTGAGCAAGGGCGAGGAGCTGTTCACCGGGGTGGTGCCCATCCTGGTCGA GCTGGACGGCGACGTAAACGGCCACAAGTTCAGCGTGTCCGGCGAGGGCGAGGGC GATGCCACCTACGGCAAGCTGACCCTGAAGTTCATCTGCACCACCGGCAAGCTGCCC GTGCCCTGGCCCACCCTCGTGACCACCCTGACCTACGGCGTGCAGTGCTTCAGCCGC TACCCCGACCACATGAAGCAGCACGACTTCTTCAAGTCCGCCATGCCCGAAGGCTAC GTCCAGGAGCGCACCATCTTCTTCAAGGACGACGGCAACTACAAGACCCGCGCCGA GGTGAAGTTCGAGGGCGACACCCTGGTGAACCGCATCGAGCTGAAGGGCATCGAC TTCAAGGAGGACGGCAACATCCTGGGGCACAAGCTGGAGTACAACTACAACAGCCA CAACGTCTATATCATGGCCGACAAGCAGAAGAACGGCATCAAGGTGAACTTCAAGA TCCGCCACAACATCGAGGACGGCAGCGTGCAGCTCGCCGACCACTACCAGCAGAAC ACCCCCATCGGCGACGGCCCCGTGCTGCTGCCCGACAACCACTACCTGAGCACCCAG TCCAAGCTGAGCAAAGACCCCAACGAGAAGCGCGATCACATGGTCCTGCTGGAGTT CGTGACCGCCGCCGGGATCACTCTCGGCATGGACGAGCTGTACAAatgattgtttattgca gcttataatggttacaaataaagcaatagcatcacaaatttcacaaataaagcatttttttcactgcattctagtt gtggtttgtccaaactcatcaatgtatcttatGCAGGGTAATAAAAACCAACACGTGGGGCCTGT GCTGTAAGGTGGCAGAGGGCGATGACTCACCCCACTCATGCAGGTTGAGTCATTTC AAGGCAGAGTTGTGCCAGTTCAGTACCCAGTAATATTTTCCAGTCGACGAGTATCAG | 2541 |

TABLE 5-continued

CONSTRUCTS USED FOR EVALUATION OF PREDICTED LOCI

| Construct name | Sequence | Length |
|---|---|---|
| | TGAACAGGAGATAACCAGTCATTTCTAGATTCTGCTCAGAGTCCCAGCTTAGAGGCT<br>CCACCAGCTCAAAGAGACGGGATGGCAAAACAGCCACCTTAATTTCCAGATCATCTG<br>CCAGCTCATCTGCCAGCTGACACACAGCCCATGGCTCCACTATTGCCAGTGCTGTAG<br>CTGCACCAGACCAATCTGGTTCAACTTTTATGTAACAAAGTTGTGATTTGTTTTTCAG<br>TTGCCCGGGACTCCCAGGTTGAAGATCATGAGCATGCCCTGATGAGCCAAGGCATG<br>CAACCACAGGGGAACCTAA (SEQ ID NO: 237) | |
| pARBI-633:<br>chr10_3_Ex<br>ogenous_8<br>9 | TGAGGTCTTGGTATGTTGCCCAGGATGGTCTCAAACTCCTGGGCTCAAGCAATCCTC<br>CTGCCTCCACCTCCCAAAGCGCTGAGATTATAGGCATGAGACACAGAGCCCAGCCAC<br>TGTCCGCATTTCMCCTGGCTTCCTTACTGGGTTCTCTACTTTCACTCTTGCCTTCTTC<br>CTCTCTTCCACCAGCATAAGTTTTAGAAACTGCACTTCTGATCATGCTGCTCTGCTGCT<br>TAAAATCCTTCATGCAGATCATGTAAGACCTTCCTGATCCAGTGCTGCCTTGCCCTCT<br>AGAACCCAGGGTGCCTTTCTCCCCTCTGCAGTTCTACTGCGCCACCTGCAGTTTCTCT<br>CTCCTGTGTTCATGTGTCTACTCCCTCTGAATGGTAGGCTCACACCCTCCACCTGGCC<br>AACTCTTACTAAATCTTGGGCTTCAACTCAAGGATCACCTTCAtgacgactgtgccttctagt<br>tgccagccatctgttgtttgccctcccccgtgccttccttgaccctggaaggtgccactcccactgtcctttccta<br>ataaaatgaggaaattgcatcgcattgtctgagtaggtgtcattctattctggggggtggggtggggcaggaca<br>gcaaggggaggattgggaagacaatagcaggcatgctggggatgcggtgggctctatggGGATCTGCG<br>ATCGCTCCGGTGCCCGTCAGTGGGCAGAGCGCACATCGCCCACAGTCCCCGAGAAG<br>TTGGGGGGAGGGGTCGGCAATTGAACGGGTGCCTAGAGAAGGTGGCGCGGGGTA<br>AACTGGGAAAGTGATGTCGTGTACTGGCTCCGCCTTMCCCGAGGGTGGGGGAGA<br>ACCGTATATAAGTGCAGTAGTCGCCGTGAACGTTCTTTTTCGCAACGGGTTTGCCGC<br>CAGAACACAGCTGAAGCTTCGAGGGGCTCGCATCTCTCCTTCACGCGCCCGCCGCCC<br>TACCTGAGGCCGCCATCCACGCCGGTTGAGTCGCGTTCTGCCGCCTCCCGCCTGTGG<br>TGCCTCCTGAACTGCGTCCGCCGTCTAGGTAAGTTTAAAGCTCAGGTCGAGACCGGG<br>CCTTTGTCCGGCGCTCCCTTGGAGCCTACCTAGACTCAGCCGGCTCTCCACGCTTTGC<br>CTGACCCTGCTTGCTCAACTCTACGTCTTTGTTTCGTTTTCTGTTCTGCGCCGTTACAG<br>ATCCAAGCTGTGACCGGCGCCTACTCTAGAGCTAGCGAATTgccgccaccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAatgattgtttattgcagcttataatgg<br>ttacaaataaagcaatagcatcacaaatttcacaaataaagcatttttttcactgcattctagttgtggtttgtcc<br>aaactcatcaatgtatcttatTGGTTCACTCCACCAGGCTGGGCTGTGTGTCCTGCCCAGTTC<br>CTATAGTGCCCTAACTCACTTTTTTAAAAAAATACTTTAAGTTCTGGGGTACATGTGC<br>AGAACATGCAGGTTTGTTACATAGGTATACATTGCCATGGTGGTTTGCTGAAGCCA<br>TCAATGTCATCTACATTAGGCATTTCTCCTAATGCTGTCCCTCCCCTAGCCTCCCACCC<br>CCCAACAGGCCCCAGTGTGTGATGTTCCCCTTCCTGTGTCCATGTGTTCTCGTTGTTC<br>AGCTTCCACTTATGAGTGAGAACATGCGGTGTTTGGTTTTCTGTTCCTGTGTTAGTTT<br>GCTGAGAATGATGCTTTCCAGCTTCATCCATGTCCCTGCAAAGGACATGAACTCATTC<br>TTTTTTATGGCTGTCCATTATTCCATGGTGTATGTGTGCCACATTTTATTTATCCAGTC<br>T (SEQ ID NO: 238) | 2541 |
| pARBI-634:<br>chr10_1_Ex<br>ogenous_9<br>2 | CCTTCCACCCCCTTCCTTAATAGTTTTCCTCCTCCGCCTCCTGCACGGCCTCCGCCTCC<br>GCCTGACCGTCCTCGGAAACCTCCCAGCCGCAGCCCGGCCCTCCCCAGCGGCCTGAG<br>TGGCCTCCTCCCGCGGCGCCCCCAGCTCCGCACCTCCCCAGCCCCGCCCGAGGCGC<br>GCCCAGCGAGCGTGACCCCGACCCAGGGCCACGGCTGCGCCCGTAGGATCGCGGG<br>CGCGCGGGTCTCCATGAGGGACTGGGAGAGATGCGTCACCCGCTAATCCCTCAACT<br>GGGTCGCACCCGGTCTGCCTTGGTTGGTCCCTTCTGATGGCGGAGGCGGGACCTCG<br>ACTTGGTGGCCAATGAGGAGCCTCGTGGGGGTGCTCTCGGCTGCCATGGCAACGGA<br>GGGGCCGCCCGCTTCCCCGCGGGGCGAGGCCGGCTCTCCCAGGACTGGCCACATg<br>acgactgtgccttctagttgccagccatctgttgtttgccctcccccgtgccttccttgaccctggaaggtgccac<br>tcccactgtcctttcctaataaaatgaggaaattgcatcgcattgtctgagtaggtgtcattctattctgggggt<br>ggggtggggcaggacagcaaggggaggattgggaagacaatagcaggcatgctggggatgcggtgggctc<br>tatggGGATCTGCGATCGCTCCGGTGCCCGTCAGTGGGCAGAGCGCACATCGCCCAC<br>AGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG | 2541 |

TABLE 5-continued

CONSTRUCTS USED FOR EVALUATION OF PREDICTED LOCI

| Construct name | Sequence | Length |
|---|---|---|
| | AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatcttatTGCAGTCACGCGCTGTGGCCCCAGTCC<br>TGTTAGCATGAGGTGGGGGTCAGAAGTTGAGGAACAACTCGGACCTAAAGCCTTGA<br>CAATTGCCAACAGTGTAGACAAGTCCCAGCATGCCCAAAATTTATAAGAGAAGGCT<br>GCCTGGAAGAGGGACACGATGAAGGAGGGTCTGCTGAAACGGACAAAGAAACCCAG<br>TTCAGTGCAGTGGAGTGGACATGGCACGGGCAGGGCACGGAGTGGGGTCGGTGCT<br>TAGTAAGCGGATTAGGGTTTCCAAGCCAAGACCCACCCAGGGCAGGATGGGGAAC<br>CAAGGTGAGCAGGTGCGCTGAATTGTGGGTCTCACACTGTCCTTCAGTGTCCCGCAG<br>GAAGAGAGAGTAAGGATCACCAGGGTCATTCCCCTGCCTCAGGCAGCCTGCACTC<br>CACCTTAGGTACAGTCATGTCCGGTCTTCAGCA (SEQ ID NO: 239) | |
| pARBI-635:<br>chr10_2_Ex<br>ogenous_9<br>1 | TGATCCTCCCACCTCAGTCTCCCAAAGAGCTGGGATTACAGGCATAAGCCACCTTGC<br>CCCGCCAGTTTTTAGCCTGTCAGCTCTTTGAGGGACACTTGTTATGGTCATACCCACA<br>GCTTTGACCCTTACCAGGTGGTCAGGTGGATGAATGAGTAGAAAGAAGGAA<br>GAGAAGGCAGGAGGGAGAAGAGGAAGAATGAAGGAAGGGTTGAGTTTGTTCTGG<br>AAGCTCCCAGCTTCCATCCGCACCACACTCTCCCTCTGTCCCCAGGACACCAGGGAA<br>CTGACTCAAGGCTCTCCTCTTACCAGGTGCTGTGTGGGGTCCAGGGAGAAGAGCCC<br>ATTTGAAATGGGGCACTGGTCTAAACTCTGGACCTGCTGCTCACTATTGACTGAACT<br>TAGCCACTTAAATATTCTCCTCTATAAAATGGGAGTGACCATAGCAACTACCTCGCTg<br>acgactgtgccttctagttgccagccatctgttgtttgccccctcccccgtgccttccttgaccctggaaggtgccac<br>tcccactgtcctttcctaataaaatgaggaaattgcatcgcattgtctgagtaggtgtcattctattctgggggt<br>ggggtggggcaggacagcaaggggggaggattgggaagacaatagcaggcatgctgggggatgcggtgggctc<br>tatggGGATCTGCGATCGCTCCGGTGCCCGTCAGTGGGCAGAGCGCACATCGCCCAC<br>AGTCCCCGAGAAGTTGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatcttatTGAATTGTAGGGAGACCCAAAAAATGT<br>ATATGAATACATTTGTCAACTAAAGAGTGTTAGGGATTATCTCAGTGGAGGGATAG<br>GCAGTGCAGGCTCTGGAACCAGACTTCTTGTGTTCACATCCCTGCTCCACTGCTTGG<br>AGACCTTTGGCAAGGTCCTTAACTCCTCTGGACCTCAGTTTTCTCATCTGTAAAACAG<br>GGATTATACTAGTTCCTACCTCACAGAGTTGTGAAGATTAAATGAGATAATGCATGA<br>AAGGCTTTTCAATAAGAGCAGGGCACACATTAGGCATGATGTCCATGATCAAGTGC<br>CTAATATGTGCCTGCTCTCAGGAAGGATGCTGTGAACTACTTCACACTAAAGTGTAA<br>ATGAATGATAAGATCTACTATGCTCCACTCATGCCTGTAATCCTAGCACTTTGGGAG<br>GCCGAAGCAAGTGGATCACCTGAGG (SEQ ID NO: 240) | 2541 |
| pARBI-636:<br>chr10_3_Ex<br>ogenous_9<br>3 | GGTGAGGTCACCCTGGGTACCTGGAGTTACTCAGAGTGACACTAGTACACGCCTGG<br>CAGGAGTGATGGATGAGCTAGGCTCCAGGAAAGCAGGTGGGGCTGGAAACCACCC<br>AAGACAAGGAAATTGTTGGGTTTGAAATTCCAGGTAAGCAGAGTATGCCTGAGAG<br>CAGCGGCAGAGGCTGAAAGTGGGCTTGGTCTCGGTATTTTTGAGGCTGAGGTAGCT<br>CCAACTCTCTCCCCTCTGAGTCAGCACCCCACTTAAGCAGAAATACTGAGATCTGCG<br>ACCCCAGCCTCCCCCACAGCAACTCCACAGTCCCCAAACCTTTGCTCCGCTGGGTCCT<br>CCCAAGTATGGTAGCTGACACAGCCCTGAGCAGCCCACTGTCCTCTGCCCTGCCAAG<br>TCTTCTCACTCTTGTCACTTTGTCCTACATCATTTCTTTGTCTGGCACCCCTCCTTgacga | 2541 |

TABLE 5-continued

CONSTRUCTS USED FOR EVALUATION OF PREDICTED LOCI

| Construct name | Sequence | Length |
|---|---|---|
| | ctgtgccttctagttgccagccatctgttgtttgcccctccccgtgccttccttgaccctggaaggtgccactccc<br>actgtcctttcctaataaaatgaggaaattgcatcgcattgtctgagtaggtgtcattctattctgggggtgggg<br>tggggcaggacagcaaggggaggattgggaagacaatagcaggcatgctggggatgcggtgggctctatg<br>gGGATCTGCGATCGCTCCGGTGCCCGTCAGTGGGCAGAGCGCACATCGCCCACAGT<br>CCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcatttttttcactgcattctag<br>ttgtgttttgtccaaactcatcaatgtatcttatAGAATTGGTGCCCCAGAGGTGGGAAAAACCT<br>ACCCTGCTCACTGCTCTATCTCCTGGGCTTAGCTCAGACTCTGGCATACGTGAGTGCT<br>TAGTAGAAACTTGATGGGGTATTAAAATTGAGACCTGGGTGGGTTCTCACATTAAAT<br>TTCTAACACTCCTTAGGTGGCTTGGGCCCACCCCTCTGAGCCCTGMCCACATCTGT<br>AAAGTAGCAAACCATCGCCATGAAGAACAGGGAAGAACCAGGTCAGCAGGCAGGG<br>CGGATGAAGCATCCAGCCAGTTCTAGGAAGTTTCCGATGGCTAATCCTTCAGATGCA<br>GCTTGTAAGCAGGTCAAATACAGAATAGGAAACTGAGGCGCAACGAAGTCATGCTT<br>AGAAGTCTGTCCAGGGAGACCAGTCAAGGCCTCCCCCACACCCTGCAAGCCCTTCTA<br>GGAGCTCTGGTTAAGTCACTC (SEQ ID NO: 241) | |
| pARBI-637:<br>chr11_1_Ex<br>ogenous_9<br>9 | ATCTTCAAATTGTAGTCTTTGTAACAACCAAATAACCTTTTGTGGTCACTGTAAAATT<br>AATATTTGGTAGACAGAATCCATGTACCTTTGCTAAGGTTAGAATGAATAATTTATTG<br>TATTTTTAATTTGAATGTTTGTGCTTTTTAAATGAGCCAAGACTAGAGGGGAAACTAT<br>CACCTAAAATCAGTTTGGAAAACAAGACCTAAAAAGGGAAGGGGATGGGGATTGT<br>GGGGAGAGAGTGGGCGAGGTGCCTTTACTACATGTGTGATCTGAAACCCTGCTTG<br>GTTCTGAGCTGCGTCTATTGAATTGGTAAAGTAATACCAATGGCTTTTTATCATTTCC<br>TTCTTCCCTTTAAGTTTCACTTGAAATTTTAAAAATCATGGTTATTTTATCGTTGGGA<br>TCTTTCTGTCTTCTGGGTTCCATTTTTTAAATGTTTAAAAATATGTTGtgacgactgtgcctt<br>ctagttgccagccatctgttgtttgcccctccccgtgccttccttgaccctggaaggtgccactcccactgtccttt<br>cctaataaaatgaggaaattgcatcgcattgtctgagtaggtgtcattctattctgggggtggggtgggca<br>ggacagcaaggggaggattgggaagacaatagcaggcatgctggggatgcggtgggctctatggGGATC<br>TGCGATCGCTCCGGTGCCCGTCAGTGGGCAGAGCGCACATCGCCCACAGTCCCCGA<br>GAAGTTGGGGGGAGGGGTCGGCAATTGAACGGGTGCCTAGAGAAGGTGGCGCGG<br>GGTAAACTGGGAAAGTGATGTCGTGTACTGGCTCCGCCTTMCCCGAGGGTGGGG<br>GAGAACCGTATATAAGTGCAGTAGTCGCCGTGAACGTTCTTTTTCGCAACGGGTTTG<br>CCGCCAGAACACAGCTGAAGCTTCGAGGGGCTCGCATCTCTCCTTCACGCGCCCGCC<br>GCCCTACCTGAGGCCGCCATCCACGCCGGTTGAGTCGCGTTCTGCCGCCTCCCGCCT<br>GTGGTGCCTCCTGAACTGCGTCCGCCGTCTAGGTAAGTTTAAAGCTCAGGTCGAGAC<br>CGGGCCTTTGTCCGGCGCTCCCTTGGAGCCTACCTAGACTCAGCCGGCTCTCCACGC<br>TTTGCCTGACCCTGCTTGCTCAACTCTACGTCTTTGTTTCGTTTTCTGTTCTGCGCCGT<br>TACAGATCCAAGCTGTGACCGGCGCCTACTCTAGAGCTAGCGAATTgccgccaccATGG<br>TGAGCAAGGGCGAGGAGCTGTTCACCGGGGTGGTGCCCATCCTGGTCGAGCTGGA<br>CGGCGACGTAAACGGCCACAAGTTCAGCGTGTCCGGCGAGGGCGAGGGCGATGCC<br>ACCTACGGCAAGCTGACCCTGAAGTTCATCTGCACCACCGGCAAGCTGCCCGTGCCC<br>TGGCCCACCCTCGTGACCACCCTGACCTACGGCGTGCAGTGCTTCAGCCGCTACCCC<br>GACCACATGAAGCAGCACGACTTCTTCAAGTCCGCCATGCCCGAAGGCTACGTCCAG<br>GAGCGCACCATCTTCTTCAAGGACGACGGCAACTACAAGACCCGCGCCGAGGTGAA<br>GTTCGAGGGCGACACCCTGGTGAACCGCATCGAGCTGAAGGGCATCGACTTCAAGG<br>AGGACGGCAACATCCTGGGGCACAAGCTGGAGTACAACTACAACAGCCACAACGTC<br>TATATCATGGCCGACAAGCAGAAGAACGGCATCAAGGTGAACTTCAAGATCCGCCA<br>CAACATCGAGGACGGCAGCGTGCAGCTCGCCGACCACTACCAGCAGAACACCCCCA<br>TCGGCGACGGCCCCGTGCTGCTGCCCGACAACCACTACCTGAGCACCCAGTCCAAGC<br>TGAGCAAAGACCCCAACGAGAAGCGCGATCACATGGTCCTGCTGGAGTTCGTGACC<br>GCCGCCGGGATCACTCTCGGCATGGACGAGCTGTACAAatgattgtttattgcagcttataat<br>ggttacaaataaagcaatagcatcacaaatttcacaaataaagcatttttttcactgcattctagttgtggttttgt<br>ccaaactcatcaatgtatcttatACATGGTAGTTCAGTTCTTAACCAATGACTTGGGGATGAT<br>GCAAACAATTACTGTCGTTGGGATTAGAGTGTATTAGTCACGCATGTATGGGGAA<br>GTAGTCTCGGGTATGCTGTTGTGAAATTGAAACTGTAAAAGTAGATGGTTGAAAGT | 2541 |

TABLE 5-continued

CONSTRUCTS USED FOR EVALUATION OF PREDICTED LOCI

| Construct name | Sequence | Length |
|---|---|---|
| | ACTGGTATGTTGCTCTGTATGGTAAGAACTAATTCTGTTACGTCATGTACATAATTAC<br>TAATCACTTTTCTTCCCCTTTACAGCACAAATAAAGTTTGAGTTCTAAACTCATTAGAA<br>TTGTTGTATTGCTATGTTACATTTCTCGACCCCTATCACATTGCCTTCATAACGACTTT<br>GGATGTATCTTCATATTGTAGATTTAGGTCTAGATTTGCTAGCTCCAAGTAATTAAGG<br>CCATGTAGGAGAGCATGGTAACCACAGATAGAACTGGTATTATCCCAAGTGGTCTG<br>CAGACTGC (SEQ ID NO: 242) | |
| pARBI-638:<br>chr11_2_Ex<br>ogenous_9<br>7 | TTACAGCACAAATAAAGTTTGAGTTCTAAACTCATTAGAATTGTTGTATTGCTATGTT<br>ACATTTCTCGACCCCTATCACATTGCCTTCATAACGACTTTGGATGTATCTTCATATTG<br>TAGATTTAGGTCTAGATTTGCTAGCTCCAAGTAATTAAGGCCATGTAGGAGAGCATG<br>GTAACCACAGATAGAACTGGTATTATCCCAAGTGGTCTGCAGACTGCTGAGTGGGG<br>ATGGGATCTGCTCTCTGTTGAGAGTTGGTAATCATTGGTTTGAAATGTGATGAAACT<br>ACTCAAGCCAATGAAGGTGGGTGTGTAGGTGGGGAGTACTTTGCCATAATATTTTA<br>AAACATTACCTGGTTAGAGTTCTAAGTGGTACTTATTTTTGTTGGTTAGGGGAAAG<br>CCTGAATAAAAACAGAAATGGACACATAATATGCATATTCCATAGTCTTTtgacgactgt<br>gccttctagttgccagccatctgttgtttgccctcccccgtgccttccttgaccctggaaggtgccactcccactg<br>tcctttcctaataaaatgaggaaattgcatcgcattgtctgagtaggtgtcattctattctgggggtggggtgg<br>ggcaggacagcaaggggaggattgggaagacaatagcaggcatgctggggatgcggtgggctctatgGG<br>ATCTGCGATCGCTCCGGTGCCCGTCAGTGGGCAGAGCGCACATCGCCCACAGTCC<br>CCGAGAAGTTGGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaatAaagcatttttttcactgcattctagttg<br>tggtttgtccaaactcatcaatgtatcttatGGGAGGCTGGAATGTGCCTGGGATTTGGGTCTA<br>AGTGTATGCGTAATTCTTACCTCACTAAAGAATTTGCCTTGTTTTTTTCCTTTTGGTGA<br>GTGACTAAAACGTCTGGGCTTCCCTGTGTGCGTGCTACAGTAAGCAAGCAGAGGCT<br>GTGCAAAGGTGTGAGCAGGATCACGTGGAATCTGGAGGATACATCTTGGCTTGCAA<br>ACTGCCTCTGTCTCCTGGGTGGGACTGTTCTGTCCTTGCACTGCTGTTCTGTGTTACC<br>TCTTGGGGTGTAAGGTTTTGCTTACAGGAGACAAACTTTGGGCGTAGAATGGAAGC<br>CACTGCCAGCCTCTGTGCTGAGAAGGAAGGTGCTTGTTTCAAAGGGAGCAGCAAGG<br>GAGGCTTGTTCTACTCACCTGGGCCTGTTTGCCTGAGAAGGGGAGATAAGGGCTGA<br>ACTGGGACTAGCCAGGGGA (SEQ ID NO: 243) | 2541 |
| pARBI-639:<br>chr11_3_Ex<br>ogenous_9<br>8 | TGGGGCTTTGGGGAATTTAGTGCGTGGGTGAGCCAAGAAAATACTAATTAATAATA<br>GTAAGTTGTTAGTGTTGGTTAAGTTGTTGCTTGGAAGTGAGAAGTTGCTTAGAAACT<br>TTCCAAAGTGCTTAGAACTTTAAGTGCAAACAGACAAACTAACAAACAAAAATTGTT<br>TTGCTTTGCTACAAGGTGGGGAAGACTGAAGAAGTGTTAACTGAAAACAGGTGACA<br>CAGAGTCACCAGTTTTCCGAGAACCAAAGGGAGGGGTGTGTGATGCCATCTCACAG<br>GCAGGGGAAATGTCTTTACCAGCTTCCTCCTGGTGGCCAAGCAGCCTGTTTCAGAG<br>GGTTGTTTTGTTTGGGGTGTGGGTGTTATCAAGTGAATTAGTCACTTGAAAGATGGG<br>CGTCAGACTTGCATACGCAGCAGATCAGCATCCTTCGCTGCCCCTTAGCAACTTtgacg<br>actgtgccttctagttgccagccatctgttgtttgccctcccccgtgccttccttgaccctggaaggtgccactcc<br>cactgtcctttcctaataaaatgaggaaattgcatcgcattgtctgagtaggtgtcattctattctgggggtggg<br>gtggggcaggacagcaaggggaggattgggaagacaatagcaggcatgctggggatgcggtgggctctat<br>ggGGATCTGCGATCGCTCCGGTGCCCGTCAGTGGGCAGAGCGCACATCGCCCACAG<br>TCCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG | 2541 |

TABLE 5-continued

CONSTRUCTS USED FOR EVALUATION OF PREDICTED LOCI

| Construct name | Sequence | Length |
|---|---|---|
| | CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgttattgc<br>agcttataatggttacaaataaagcaatagcatcacaaatttcacaaataaagcatttttttcactgcattctag<br>ttgtggtttgtccaaactcatcaatgtatcttatAGGTGGTTGATTTGAAACTGTGAAGGTGTGAT<br>TTTTTCAGGAGCTGGAAGTCTTAGAAAAGCCTTGTAAATGCCTATATTGTGGGCTTTT<br>AACGTATTTAAGGGACCACTTAAGACGAGATTAGATGGGCTCTTCTGGATTTGTTCC<br>TCATTTGTCACAGGTGTCTTGTGATTGAAAATCATGAGCGAAGTGAAATTGCATTGA<br>ATTTCAAGGGAATTTAGTATGTAAATCGTGCCTTAGAAACACATCTGTTGTCTTTTCT<br>GTGTTTGGTCGATATTAATAATGGCAAAATTTTTGCCTATCTAGTATCTTCAAATTGT<br>AGTCTTTGTAACAACCAAATAACCTTTTGTGGTCACTGTAAAATTAATATTTGGTAGA<br>CAGAATCCATGTACCTTTGCTAAGGTTAGAATGAATAATTTATTGTATTTTTAATTTG<br>AATGTTTGTGCTTT (SEQ ID NO: 244) | |
| pARBI-640:<br>chr11_1_Ex<br>ogenous_9<br>4 | CGACCAACCCATCAAACTCCCCGCCCCCAGCACTTTTATTTCTCCTCTTTAGGAAGTA<br>CACTTCAGTATCMGGCACAGTGCATGAGCACGACTAAAGTAAAACATCGCAGAAA<br>ACATAGCTTTAGTCTACCCTTCGTGTCCTAAAAGGAAAACCAGTAGCTTCCCAGGCC<br>ACCGGAAGGGCAACACATGTCCTCTGCAGTTTCTGCACACGGGAAGGTAAAGACAG<br>AGAGAGGACCTACTCCTCAACACAGAAACATTTCAAATCTTTCCTCGCCTGCAACCC<br>AAGCTGAAGTCATTCTCCCCAGAAATAACAAAAGTTGGAAGAGAAGCCGGAGACAG<br>GATAGGTGCAGGAAGCCCACACTTTGAGGGCAGCACTCAGACACCCTCTCCTGTGT<br>GCAGGACGTGCCGAATGTTCAGGTGCAATGAGAATGAGCCATGCTTGGCTTAtgacg<br>actgtgccttctagttgccagccatctgttgtttgccctcccccgtgccttccttgaccctggaaggtgccactcc<br>cactgtccttcctaataaaatgaggaaattgcatcgcattgtctgagtaggtgtcattctattctgggggtggg<br>gtggggcaggacagcaagggggaggattgggaagacaatagcaggcatgctggggatgcggtgggctctat<br>ggGGATCTGCGATCGCTCCGGTGCCCGTCAGTGGGCAGAGCGCACATCGCCCACAG<br>TCCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcatttttttcactgcattctag<br>ttgtggtttgtccaaactcatcaatgtatcttatCGAGGGCAATCTGGCCCATCAAGTGGCCTTCG<br>CCTCTGGGAGTAACAAAAATGCACTTCAAAATAGCTTCTGTAATCAAGCTGCATGGG<br>TGGAGTACTCCCCAGCTGACTCCAGGAAGTTCTCTATCCAAAGCTATTCATTAGGCC<br>AGAGCTGTGCAAATAATTAGTCACCCACTTGCTCCATAACCCTCCATGACAGCCCAG<br>GCATTGAGTCCAGGTGGGACCATCAAGCCATGCTCTGGTGGCTCATGCATTATCATA<br>GAAATGGGAGGCTTTATTTATTTTACTAAAAAGAACAAAAACAACAGACTGCTGTCC<br>TTTAGACAATAGGATCACGTCATCTGAGCCCTCTGTGCCCAGGTGACAAGCCCAGC<br>CCCAAGTTCTCTTTCCTCAGCCTCCCCACACATGTTCTGGAGGAGATGGGCCCAGCA<br>GGCTGCTCTGAGGCCTGGC (SEQ ID NO: 245) | 2541 |
| pARBI-641:<br>chr11_2_Ex<br>ogenous_9<br>6 | TCACAGAATCTTGTTTGAGCTAACAACCAGTTATTCTACCCAAAGTAAAGAGTAACTT<br>AAATTTTCCCATTGTTCTTCCAGGCTGGAAGATGTAAGAAACACACAGTATAGTG<br>TAGGTTTCCTCCATAGTTAAGTACCCCAGAGCTAGGCTGAAATCCAGTCAGTGTTGGATTG<br>TTTCCAACTTATAGTAGGGAACCGCCAATGACATGAAAGAGCATTACCTTACCGGAC<br>TGATTCATATTCTACTTCCAGTCATAGTACAAATGATCACATGTCCACACCCACATGT<br>GCTCTGATAAGTAGTCAATTGAGAGGAGTGAGTCAGGGAGCCGTAACTTTGCAGCC<br>AACCTGCCAAGAAGAACTGATGCTTTTAGAAATTCAGCAGCTTTCATTGGCATAGAA<br>GTTTCAGCCTTATAGGCCCAGGGTTTCTCTGAGGCAGAGGCAAACCCTGTtgacgactg | 2541 |

TABLE 5-continued

CONSTRUCTS USED FOR EVALUATION OF PREDICTED LOCI

| Construct name | Sequence | Length |
|---|---|---|
| | tgccttctagttgccagccatctgttgtttgccctccccgtgccttccttgaccctggaaggtgccactcccact<br>gtcctttcctaataaaatgaggaaattgcatcgcattgtctgagtaggtgtcattctattctgggggtggggtg<br>gggcaggacagcaaggggggaggattgggaagacaatagcaggcatgctggggatgcggtgggctctatggG<br>GATCTGCGATCGCTCCGGTGCCCGTCAGTGGGCAGAGCGCACATCGCCCACAGTCC<br>CCGAGAAGTTGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcatttttttcactgcattctagttg<br>tggtttgtccaaactcatcaatgtatcttatTGTTATGTTGTTATCTCAGGATTCTTTTTTTTTTTTT<br>TGAGACAGAGTCTCACTCTGTTGCCCAGGCTGGAGTGCAGTGGCACAATCTCGGCTC<br>ACTGCAAGCTCCGCCTCCCGGGTTCACGCCATTCTCCTGCCTCAGCCTCCCGAGTAGC<br>TGGGACTACAGGCGCCCGCCACCACGCCTTTCTAAATTTTGTATTTTTAGTAGAGAC<br>GGGGATTTCACCATGTTAGCCAGGATGGTCTCGATCTCCTGACCTCGTGATCCGCCGC<br>CCTGGCCTCCCAAAGTGCTGGGATTACAGGCGTGAGCCACTGCGCCCAGCCTATCTC<br>AGGATTCTTAATGTAAAAACAGTTCAGTATGGAAAGCGTACTTATGACAGAGCTGTT<br>GCAGAATGTGAAATCACCCATGTGCCTAAGTGTCTCCCTACTACCTGGAACACTAGA<br>CCACATGCAGCAG (SEQ ID NO: 246) | |
| pARBI-642:<br>chr11_3_Ex<br>ogenous_9<br>5 | CAGCCCTGAACTCAGCCTTCACGGCCCTCCCTAAACACATGGGCCAGCCACAGGGAA<br>GAAAAAAATGCCCTGTAGCACAGGAATCTAAACATTGCTGTTGTTCTAGTTAATAA<br>AAGGACTTAGAGATTGAAAAGAAGTACCATCTGTATGGCTGGCAACAGACAGCATG<br>ATTTTGATGACTGACTCTGGGGAGATCTGAGAAAACAGTACATAATATGTCCTTACC<br>TCTGCTCCATCATTCATGACCCAAGCTCCTGCCCTGTCTTCTCAGGAAGATTCTTACA<br>GTAACTCCAGTTTGGAATTCCCCTTTCATATTTGAAATAACAACAGTAATAGTGACCA<br>CTAATGCTTACCGAGTGTCCACTCTGTGCCAAGCATCGTGTTTTTATCATCTTTTTTGT<br>TAGGCACTGTACATGGATTAATACAATTACAACCCACCACAACCCCATgacgactgtgc<br>cttctagttgccagccatctgttgtttgccctccccgtgccttccttgaccctggaaggtgccactcccactgtc<br>ctttcctaataaaatgaggaaattgcatcgcattgtctgagtaggtgtcattctattctgggggtggggtgggg<br>caggacagcaaggggaggattgggaagacaatagcaggcatgctggggatgcggtgggctctatggGGA<br>TCTGCGATCGCTCCGGTGCCCGTCAGTGGGCAGAGCGCACATCGCCCACAGTCCCC<br>GAGAAGTTGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcatttttttcactgcattctagttgtggtt<br>tgtccaaactcatcaatgtatcttatGAGATAAGTACTTGTACTATCCTCATTTTATGGGTGAT<br>GATACAAGAAACAGAAAGGTTCAGCAACATGCCTAAAGCCACACAGCTACTATGAG<br>GCAAAGTCTAGGTTTGAACTCAGAAATTCTGACTTCAGACTCACTTATCTTATTATAC | 2541 |

TABLE 5-continued

CONSTRUCTS USED FOR EVALUATION OF PREDICTED LOCI

| Construct name | Sequence | Length |
| --- | --- | --- |
| | TTCACTTAGTATCTCCCATTAATTAATTCATTCATTCTTCCTTTTATTTGTTAATTCACC<br>AAATATTCTGGGAAGCTACTTGTCTAGACACTGTATGAAAAATGAGAATGGATACAA<br>AGCAACCTCAGACATGAACTCAAGGTCCTTACAAGCTTAAACGTATATGATACATTTC<br>CAAATAGCAATACTATGAGGACAGCTGATACTCACAACATAAGTCTTGGTGGTCACA<br>GGAGATCTATCATAGGATTTCACGAAGAACCTGACACTGAAAACCAGAACTTGAGG<br>GAAATAAAAC (SEQ ID NO: 247) | |
| pARBI-643:<br>chr15_1_Ex<br>ogenous_1<br>00 | GTGTCCATCCTGCATGTCTCAAGTCACAATCCTCCAGATATTCAACCAAAGTGCTTGA<br>TTCTGTTGGCACAAGGACCATGAAATCTTCAGTAGCTAAGGAGACTCTTTGACAAAT<br>AGATTTATTGCATATGATGTAAAAGGGTCTCATTCAGAGAACTACACATTTACTACAC<br>ATTTACTAGCTGTTAGATGTGAGAAATTGAAGCTTTGAGAATTGTCATTTTGTAAGC<br>ACGCTGTAATAATTGTGTTCTCTACAAAAATGGAGAAATACTTAATCMGCAGGTTT<br>TTATTAGCTTCGAAAAAGGGAATACAAATATTTTGATACCTGACTTTATTTTAAAGAT<br>ACTGGCAAGCAAGGAAAGATACTCAGTTTGCTAAATTATAGCATAGATTTGAAAGAC<br>GGAAATTTTTTTTGTTATTTTGATTCTTTCTGATTCAGAACCTGCGtgacgactgtgccttc<br>tagttgccagccatctgttgtttgcccctcccccgtgccttccttgaccctggaaggtgccactcccactgtcctttt<br>cctaataaaatgaggaaattgcatcgcattgtctgagtaggtgtcattctattctgggggtgggtggggcag<br>gacagcaaggggaggattgggaagacaatagcaggcatgctggggatgcggtgggctctatggGGATCT<br>GCGATCGCTCCGGTGCCCGTCAGTGGGCAGAGCGCACATCGCCCACAGTCCCCGAG<br>AAGTTGGGGGAGGGGTCGGCAATTGAACGGGTGCCTAGAGAAGGTGGCGCGGG<br>GTAAACTGGGAAAGTGATGTCGTGTACTGGCTCCGCCTTMCCCGAGGGTGGGGG<br>AGAACCGTATATAAGTGCAGTAGTCGCCGTGAACGTTCTTTTTCGCAACGGGTTTGC<br>CGCCAGAACACAGCTGAAGCTTCGAGGGGCTCGCATCTCTCCTTCACGCGCCCGCCG<br>CCCTACCTGAGGCCGCCATCCACGCCGGTTGAGTCGCGTTCTGCCGCCTCCCGCCTG<br>TGGTGCCTCCTGAACTGCGTCCGCCGTCTAGGTAAGTTTAAAGCTCAGGTCGAGACC<br>GGGCCTTTGTCCGGCGCTCCCTTGGAGCCTACCTAGACTCAGCCGGCTCTCCACGCT<br>TTGCCTGACCCTGCTTGCTCAACTCTACGTCTTTGTTTCGTTTTCTGTTCTGCGCCGTT<br>ACAGATCCAAGCTGTGACCGGCGCCTACTCTAGAGCTAGCGAATTgccgccaccATGGT<br>GAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCA<br>CCTACGGCAAGCTGACCCTGAAGTTCATCTGCACCACCGGCAAGCTGCCCGTGCCCT<br>GGCCCACCCTCGTGACCACCCTGACCTACGGCGTGCAGTGCTTCAGCCGCTACCCCG<br>ACCACATGAAGCAGCACGACTTCTTCAAGTCCGCCATGCCCGAAGGCTACGTCCAGG<br>AGCGCACCATCTTCTTCAAGGACGACGGCAACTACAAGACCCGCGCCGAGGTGAAG<br>TTCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAgatgattgtttattgcagcttataatgg<br>ttacaaataaagcaatagcatcacaaatttcacaaataaagcattttttcactgcattctagttgtggtttgtcc<br>aaaactcatcaatgtatcttatTGAGTTTCCATTCCTGGGATAGAGAGCCCTGCCAAAGCCAA<br>CTCAGTCTCCTGTTATTGCAGAAATTTAAAGGTTACTTGAGCTGATTGATACCAATTA<br>AAATAAAAGCATCTACTGCCATTTTATTAAACGCCCTATTTAATCTCCACATCCCAAG<br>TTCATTCTCTCTCTCTTTTAAGGCTATACATGGGCCTCAACATTCTCTCTTCTTCAGTAT<br>CAGCTGTCCTCATCCCTATTCAAAGTCAGAATGACTTGGAATCTATTCAGGGCTGCTA<br>CTTAATTGGATGAAGAAAGTACTCTGTTGCATGCTAACCTCCCAGATTTGAATTAGA<br>ACCAAGGTCCTGAATCTACACAAGACCTTTTCCCTTTCCTTTCTGCATTTATTTCTTTT<br>TTTTCTACATCTTTCTTTTTGAATTTTTTTTTTTTTTTCTGAGATAGAGTCTTG<br>(SEQ ID NO: 248) | 2541 |
| pARBI-644:<br>chr15_2_Ex<br>ogenous_1<br>01 | ATCATCAAAATCTTCATTTATACAAATCACGGGTATTAGAAATAAAATCAGGTATTGT<br>GTACAGTCAGATCCCAGGTTTACACAAACTAGAGGTTTCAATTAAGTTTCCTTCATTT<br>TATAAAACCATGACACAAGCTGTAAATAAAGGAGCTCTGGCTTTAGGCCTTCTTCTG<br>TTTATAGACAGTAAATTTTAATCCTCTGTCCCTGCAGACCAACTCAAAGCAGTAACCT<br>TGGCTACCGTTGCCGCAGAAGAAACACACCCTGCAGATTTCCAGTTCTATATTCAGT<br>CTTAGAAAATTGGTCATGTTGAAAGGGAAAAAACAATTTTACTTTGCCTCAGTTATT<br>GACACCAAGAAGCACTCCTCAGCCTGTTCAGAGGGGAAACAATGAGTCATTCATGCT<br>GTCAGCCCAGGTGGTGCATGAATTCCAGACAGAGGCCGCTGAATTAACtgacgactgtg<br>ccttctagttgccagccatctgttgtttgcccctcccccgtgccttccttgaccctggaaggtgccactcccactgt<br>cctttcctaataaaatgaggaaattgcatcgcattgtctgagtaggtgtcattctattctgggggtgggtggg<br>gcaggacagcaaggggaggattgggaagacaatagcaggcatgctggggatgcggtgggctctatggGG<br>ATCTGCGATCGCTCCGGTGCCCGTCAGTGGGCAGAGCGCACATCGCCCACAGTCCCC<br>GAGAAGTTGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG | 2541 |

TABLE 5-continued

CONSTRUCTS USED FOR EVALUATION OF PREDICTED LOCI

| Construct name | Sequence | Length |
|---|---|---|
| | CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcatttttttcactgcattctagttgtggtt<br>tgtccaaactcatcaatgtatcttatCCGTGGAGGCGTCTCTCTGAGCAGAGCCCGCAATGCG<br>CCTGCTTGGGGCTCCCTGCAGCCTCTGGGGAGGCAGGGCGGCCCAGAGCAGGCC<br>TGTGCTGGAAAGGAACGCGAAGCCCTGTAACCAAGCCTGTACCTCTGCAGTGCTAG<br>TCCCAAGGGGCCTCCGAGCTGTTTGTCACCATGTGATTGGCTCAGGAGAGGGGTGG<br>AGAAATGAAAACACTCTGCCCAGGATATATTTAGTTGAAGTGCAGCTGGGGAAGTG<br>CTTAAACAAGGGAGCTTTTGTCCTTATGTTGAAGTGTTTTTCTTAACTCCTCAAGGGT<br>GAAAAACTTGAGCCACGTACTGATCCCATTCCCCCCCACCACCCCCAATATATTTTCT<br>CTTCTTTAGGAAATGCTCTTATTCTGAAACTTTAGAATTTTCTAGGGTTTGTTGCATAA<br>GAGGAAACTGAATAA (SEQ ID NO: 249) | |
| pARBI-645:<br>chr15_3_Ex<br>ogenous_1<br>02 | CTTTCCTTTCTGCATTTATTTCTTTTTTTTCTACATCTTTCTTTTTGAATTTTTTTTTTTT<br>TTTTTTCTGAGATAGAGTCTTGCTCTGTCGCCAGGCTGGAGTGCAGTGGTGTGATCT<br>TGGCTCACTGCAGTCTCCAACTCTGGTTCAAGCAATTCTCCTGCCTCAGCCTCCGGGT<br>AGCTGGGACTACAGGCATACACCACCATGCCCAGCTAATTTTTGTATTTTTAGTAGA<br>GATGGGGTTTCACCATAGTGGCCAGGATGGTCTCCATCTCTTGACCTCGTGACCTGA<br>CCCCCCTCGGCCTCCCAAAGTGCTGAGATTACAGGCATGAGCCACCGCGCCCGGCCTC<br>TTTTTGAATTTTTTTAAAAAAACACCTAAAGTTTAGGAAAGTATAAGAGGCCAAAGA<br>AACAAGAGTTCAAAGAAACAAGAGTGTTATACACGCACACTTGCAtgacgactgtgccttc<br>tagttgccagccatctgttgtttgccctccccgtgccttcttgacccctggaaggtgccactcccactgtcctttt<br>cctaataaaatgaggaaattgcatcgcattgtctgagtaggtgtcattctattctgggggtggggtggggcag<br>gacagcaagggggaggattgggaagacaatagcaggcatgctggggatgcggtgggctctatggGGATCT<br>GCGATCGCTCCGGTGCCCGTCAGTGGGCAGAGCGCACATCGCCCACAGTCCCCGAG<br>AAGTTGGGGGAGGGGTCGGCAATTGAACGGGTGCCTAGAGAAGGTGGCGCGGG<br>GTAAACTGGGAAAGTGATGTCGTGTACTGGCTCCGCCTTMCCCGAGGGTGGGGG<br>AGAACCGTATATAAGTGCAGTAGTCGCCGTGAACGTTCTTTTTCGCAACGGGTTTGC<br>CGCCAGAACACAGCTGAAGCTTCGAGGGGCTCGCATCTCTCCTTCACGCGCCCGCCG<br>CCCTACCTGAGGCCGCCATCCACGCCGGTTGAGTCGCGTTCTGCCGCCTCCCGCCTG<br>TGGTGCCTCCTGAACTGCGTCCGCCGTCTAGGTAAGTTTAAAGCTCAGGTCGAGACC<br>GGGCCTTTGTCCGGCGCTCCCTTGGAGCCTACCTAGACTCAGCCGGCTCTCCACGCT<br>TTGCCTGACCCTGCTTGCTCAACTCTACGTCTTTGTTTCGTTTTCTGTTCTGCGCCGTT<br>ACAGATCCAAGCTGTGACCGGCGCCTACTCTAGAGCTAGCGAATTgccgccaccATGGT<br>GAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCA<br>CCTACGGCAAGCTGACCCTGAAGTTCATCTGCACCACCGGCAAGCTGCCCGTGCCCT<br>GGCCCACCCTCGTGACCACCCTGACCTACGGCGTGCAGTGCTTCAGCCGCTACCCCG<br>ACCACATGAAGCAGCACGACTTCTTCAAGTCCGCCATGCCCGAAGGCTACGTCCAGG<br>AGCGCACCATCTTCTTCAAGGACGACGGCAACTACAAGACCCGCGCCGAGGTGAAG<br>TTCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatGAAAGGTAGTAAAATATCTGTATAGTTCTGGCTGTCAAGCT<br>TTTGGACTGAGATATGCGTAAGCAAGGCAAAAAGATCCCATAGTCCAGGAATATCA<br>ACCAGTCCAGTTTCCCAAGGAAACTAAAAGTAACTGAAAATGAGAAGGGTGCCATA<br>TAGGAAAATTGAAGGTGGGGCATAATTATTAATACACTGCTTTGGAAATGCTGGTAT<br>GGAAGATTCATATATGGACTTCAAAGCATACATGTCTTATACTTAGCTATGGGAAAA<br>TTATCATCAAAATCTTCATTTATACAAATCACGGGTATTAGAAATAAAATCAGGTATT<br>GTGTACAGTCAGATCCCAGGTTTACACAAACTAGAGGTTTCAATTAAGTTTCCTTCAT<br>TTTATAAAACCATGACACAAGCTGTAAATAAAGGAGCTCTGGCTTTAGGCCTTCTTCT<br>GTTTATAGA (SEQ ID NO: 250) | 2541 |
| pARBI-646:<br>chr16_1_Ex<br>ogenous_1<br>03 | TGTCTTCACGGCACGGCCCCGCTTCACCAGCTGCACTGTTTGATGAGCTTTGCAGG<br>TCCAGATCTTATAAGCTCATGGTGATTGATCCAAATGATGCAGAGGTCGGCCTAAA<br>GTTAGAAGTGGGCCCTCTCTGCCCCAAGACAGCCCTTCACCCCAATTCCATTCCCAC<br>AGTTTGGGCATCCACCCAGGCTGCCAAGCCAAGCGGGGCTGCCCGGGTTAGCAG<br>GGACCTGGCCATGGGCCTCCTCAGCTAGGGGCCGCCTCTCTGAGGAGTGGGTGCCC<br>CGCCCCTCCGTGGGCCGCCTGGTTTCTCTTATTGGCAGCGTCTGTAGTCCCCTGGCTC<br>TGTCACCCGCAGCTATTCTAGGCCTCTGGTTCCTTTCACTTTCTGCTCTGCGTCTTCCT<br>GCCTCGGTGGTTCCCCACCATCCAGCCTGAGACCTCCCCGTTGCCCGCCCtgacgactgt | 2541 |

TABLE 5-continued

CONSTRUCTS USED FOR EVALUATION OF PREDICTED LOCI

| Construct name | Sequence | Length |
|---|---|---|
| | gccttctagttgccagccatctgttgtttgccctccccgtgccttccttgaccctggaaggtgccactcccactg<br>tcctttcctaataaaatgaggaaattgcatcgcattgtctgagtaggtgtcattctattctggggggtggggtgg<br>ggcaggacagcaaggggaggattgggaagacaatagcaggcatgctggggatgcggtgggctctatgGG<br>GATCTGCGATCGCTCCGGTGCCCGTCAGTGGGCAGAGCGCACATCGCCCACAGTCC<br>CCGAGAAGTTGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAAatgattgtttattgcag<br>cttataatggttacaaataaagcaatagcatcacaaatttcacaaataaagcatttttttcactgcattctagttg<br>tggtttgtccaaactcatcaatgtatcttatTGGGTTTCTGTCTGCTCCTCTCCGTGGTGGCCGGC<br>CCTGGCTCTGCCCCAAAGCCATGGAGAAGGCCAAATGCAGGCTGTAGAAAGGTCTG<br>GGATCAGATCCCCCCATCCTTCCATGGCCACGTGACCGGGCCCGCCTCTTCCCTCTGA<br>GCCTCACATCCTCATCTGAAGAGGGAATGCTGCTCATGCCCACCTTGCGGGGATGTG<br>GGGAGGGGGTGCTGCCAGTGGAGACTCCCAGGGGACCCTCCAGGAGTCTCATCCT<br>GACTCGAGACTGGGCACCTGGTGGGGGCACAGGCCCCCTCTCCCGCCATGGGACCG<br>CCACATCCAGGCTCTCGTGGGTTGAGATGCTGAGGAAAGGAAAGAACAAAACCTGC<br>TGGAGGAGCAGCGAACACGGCCCTCAGCTGGGTGACCTTGGGCAAGTCACTTCCCC<br>TCTCTGGGCCTCAGTTTCCAT (SEQ ID NO: 251) | |
| pARBI-647:<br>chr16_2_Ex<br>ogenous_1<br>04 | CTGAAGAGGGAATGCTGCTCATGCCCACCTTGCGGGGATGTGGGGAGGGGGTGCT<br>GCCAGTGGAGACTCCCAGGGGACCCTCCAGGAGTCTCATCCTGACTCGAGACTGGG<br>CACCTGGTGGGGGCACAGGCCCCCTCTCCCGCCATGGGACCGCCACATCCAGGCTCT<br>CGTGGGTTGAGATGCTGAGGAAAGGAAAGAACAAAACCTGCTGGAGGAGCAGCGA<br>ACACGGCCCTCAGCTGGGTGACCTTGGGCAAGTCACTTCCCCTCTCTGGGCCTCAGT<br>TTCCATATCTGTGAATGAGGCAGCTGGACTGAAGAATAGAGAGTCACAAAGCAGAG<br>TGACACAAACTGGGCTACAGGAAACCCTGGAGGCCCTCGACCCAGGCTGGGGCCG<br>GGGATGGTTCTGCAAAGCCTCTTGGGAGAGGGTTGCCTGACTGAGTCTCCAAACA<br>GAAtgacgactgtgccttctagttgccagccatctgttgtttgccctccccgtgccttccttgaccctggaag<br>gtgccactcccactgtcctttcctaataaaatgaggaaattgcatcgcattgtctgagtaggtgtcattctattct<br>ggggggtggggtggggcaggacagcaaggggaggattgggaagacaatagcaggcatgctggggatgcg<br>gtgggctctatgGGATCTGCGATCGCTCCGGTGCCCGTCAGTGGGCAGAGCGCACATC<br>GCCCACAGTCCCCGAGAAGTTGGGGGAGGGGTCGGCAATTGAACGGGTGCCTAG<br>AGAAGGTGGCGCGGGGTAAACTGGGAAAGTGATGTCGTGTACTGGCTCCGCCTTTT<br>TCCCGAGGGTGGGGGAGAACCGTATATAAGTGCAGTAGTCGCCGTGAACGTTCTTT<br>TTCGCAACGGGTTTGCCGCCAGAACACAGCTGAAGCTTCGAGGGGCTCGCATCTCTC<br>CTTCACGCGCCCGCCGCCCTACCTGAGGCCGCCATCCACGCCGGTTGAGTCGCGTTC<br>TGCCGCCTCCCGCCTGTGGTGCCTCCTGAACTGCGTCCGCCGTCTAGGTAAGTTTAA<br>AGCTCAGGTCGAGACCGGGCCTTTGTCCGGCGCTCCCTTGGAGCCTACCTAGACTCA<br>GCCGGCTCTCCACGCTTTGCCTGACCCTGCTTGCTCAACTCTACGTCTTTGTTTCGTTT<br>TCTGTTCTGCGCCGTTACAGATCCAAGCTGTGACCGGCGCCTACTCTAGAGCTAGCG<br>AATTgccgccaccATGGTGAGCAAGGGCGAGGAGCTGTTCACCGGGGTGGTGCCCATC<br>CTGGTCGAGCTGGACGGCGACGTAAACGGCCACAAGTTCAGCGTGTCCGGCGAGG<br>GCGAGGGCGATGCCACCTACGGCAAGCTGACCCTGAAGTTCATCTGCACCACCGGC<br>AAGCTGCCCGTGCCCTGGCCCACCCTCGTGACCACCCTGACCTACGGCGTGCAGTGC<br>TTCAGCCGCTACCCCGACCACATGAAGCAGCACGACTTCTTCAAGTCCGCCATGCCC<br>GAAGGCTACGTCCAGGAGCGCACCATCTTCTTCAAGGACGACGGCAACTACAAGAC<br>CCGCGCCGAGGTGAAGTTCGAGGGCGACACCCTGGTGAACCGCATCGAGCTGAAG<br>GGCATCGACTTCAAGGAGGACGGCAACATCCTGGGGCACAAGCTGGAGTACAACTA<br>CAACAGCCACAACGTCTATATCATGGCCGACAAGCAGAAGAACGGCATCAAGGTGA<br>ACTTCAAGATCCGCCACAACATCGAGGACGGCAGCGTGCAGCTCGCCGACCACTAC<br>CAGCAGAACACCCCCATCGGCGACGGCCCCGTGCTGCTGCCCGACAACCACTACCTG<br>AGCACCCAGTCCAAGCTGAGCAAAGACCCCAACGAGAAGCGCGATCACATGGTCCT<br>GCTGGAGTTCGTGACCGCCGCCGGGATCACTCTCGGCATGGACGAGCTGTACAAAatg<br>attgtttattgcagcttataatggttacaaataaagcaatagcatcacaaatttcacaaataaagcatttttttca<br>ctgcattctagttgtggtttgtccaaactcatcaatgtatcttatCAGTGGCCTTAAGTCACGGGAGAT<br>GAGCCAGAGCAGTCCAGAGGGCACGGTCAGCACATGCTAAGGTCCTGGGGCACAG<br>AGTACAGGGCTTGAGAAGGGTTCCTCTTGCTCCATGTGACTTTCATCATCCAACAGC | 2541 |

TABLE 5-continued

CONSTRUCTS USED FOR EVALUATION OF PREDICTED LOCI

| Construct name | Sequence | Length |
|---|---|---|
| | CTGTGGTGGCACTTGCCTGTATCCCAGCTATCTAGGAGGCTGAGGTGGGAGGATTG<br>CTTGAGTCTGAGAGGTCGGGCTTGTTCTCCCGGTGTTGGCAGAGTCCAGAGGGAGC<br>AAGTGGAAGCCACAGGTGTCTTGAGGCCTAGGCTGAGATCTAGCACATCACCGCGT<br>CACTTCATCCCTTCATTTCATCCTATTGGCCAAAGCAGCCCAATTCTAGGGATGGGGA<br>TCTAGACTCAACTTCTTGATGGGAGAAGTAGCAAAGTCACACTGCCAAGGGCAGGG<br>ACACAGGGAGGGATGAAGAGTTAGGAATGGTT (SEQ ID NO: 252) | |
| pARBI-648:<br>chr16_3_Ex<br>ogenous_1<br>05 | AAGCCACCTCCCTGCTCTGTTGCTGGCTCTCCTTGAAGACAAGTGTTTTTCAATTAAC<br>CAAAGCGGTGCATGGCAATGTGATAGGGGAATGAAACACAGCAACAGAATCAATG<br>CCCCACGCTGGGCAATAGCCGACTTTCTGTTCGCTCCCATCCCTTCCTTCCCTCCCCGC<br>CTCCTTCCCCTGCTCCTTCCATTCCACAAACATTTATTGAGCACCCGCTGTGTGCCAGC<br>CACTGTTCTAGGCCCTGAAGACACAGAAGTGAACAAAAAAAAAAGAGTCCCTGTGCA<br>CATCCTGGAGGGACTTTCCCCGTGTGTGTGTGTGTGTGTGTGTGTGTGTCTATAC<br>AGTGTATGGAGACAGTGGATAATAAAAGCTGTTTATGAGGCACTTTCTCTGAGCTGT<br>TCCATGTGCTTCACTTATACTCATTCAGCTAATCCTCAGGACACCCCCGtgacgactgtgc<br>cttctagttgccagccatctgttgtttgccccctcccccgtgccttccttgaccctggaaggtgccactcccactgtc<br>ctttcctaataaaatgaggaaattgcatcgcattgtctgagtaggtgtcattctattctgggggtggggtgggg<br>caggacagcaaggggggaggattgggaagacaatagcaggcatgctgggatgcggtgggctctatggGGA<br>TCTGCGATCGCTCCGGTGCCCGTCAGTGGGCAGAGCGCACATCGCCCACAGTCCCC<br>GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAgattgtttattgcagcttat<br>aatggttacaaataaagcaatagcatcacaaatttcacaaataaagcattttttcactgcattctagttgtggtt<br>tgtccaaactcatcaatgtatcttatTGAAGTCAGTGATATTAGTCACAGAGGCCCAGAGAAG<br>TGAAGTGACTTGCCCAAGGTCACACAGCCAGCAAGAGGCCAAGCCCGGATTGAACC<br>CCAGCCGCCTGGCTCTGGAGCCTGCAGCATAACCACAGCAGGGAACTGCCACCGGA<br>GACAGACATCGACAGCCACTAGGAGATGTTAACCAACAGGCTTGTCTTCACGGCAC<br>GGCCCCCGCTTCACCAGCTGCACTGTTTGATGAGCTTTGCAGGTCCCAGATCTTATAA<br>GCTCATGGTGATTGATCCAAATGATGCAGAGGTCGGCCTAAAGTTAGAAGTGGGCC<br>CCTCTCTGCCCCAAGACAGCCCTTCACCCCAATTCCATTCCCACAGTTTGGGCATCCA<br>CCCAGGCTGCCAAGCCAAGCGGGGGCTGCCCGGGTTAGCAGGGACCTGGCCATGG<br>GCCTCCTCAGCTAGGGGC (SEQ ID NO: 253) | 2541 |
| pARBI-649:<br>EDF1_1_Ex<br>ogenous_2<br>5 | GGGGGCGGCCGCACGGCTAGAGCGGAGACCCCGCGCCCCTCCGCCCGCGTGGCC<br>CGGCCGGGGTGCGGGGCCCGGGGAGGCACGGGGGCTGCGCGTCGGGGCGCAGCC<br>GCCGCCCGCGTGTGCTCGGAGGCCGCGGGGCCCGGGCTCCGGGGTCCTCCCGACCT<br>GCAGCCCCAGCGGCTACCGCGCCTCGCCAGGCCAGGCCAGGCCCCGACGTCGCCTT<br>CCCTACGTCGCCGGCGCCCGGCCACGACGTCCCTCAGACGAGCCGGAACGCCGAATG<br>GCCCCGAGCACGGGAAGTGCCCGCCCCCGCGTGCAGCCAGCCAATGGGACGCCG<br>AAAGCGGGGAGGTGCCGAGGGGACGTAGCGTCGCCGCGCCAGGTCTCTAGCAGCT<br>GCCGCTGAGCCGCCGGACGGACGCTCGTCTTCGCCCGCCATGGCCGAGAGCGACTG<br>GGACACGtgacgactgtgccttctagttgccagccatctgttgtttgccccctcccccgtgccttccttgaccctg<br>gaaggtgccactcccactgtcctttcctaataaaatgaggaaattgcatcgcattgtctgagtaggtgtcattct<br>attctgggggtggggtggggcaggacagcaaggggggaggattgggaagacaatagcaggcatgctgggga<br>tgcggtgggctctatggGGATCTGCGATCGCTCCGGTGCCCGTCAGTGGGCAGAGCGCAC<br>ATCGCCCACAGTCCCCGAGAAGTTGGGGGGAGGGGTCGGCAATTGAACGGGTGCC<br>TAGAGAAGGTGGCGCGGGGTAAACTGGGAAAGTGATGTCGTGTACTGGCTCCGCC<br>TTTTTCCCGAGGGTGGGGGAGAACCGTATATAAGTGCAGTAGTCGCCGTGAACGTT<br>CTTTTTCGCAACGGGTTTGCCGCCAGAACACAGCTGAAGCTTCGAGGGGCTCGCATC<br>TCTCCTTCACGCGCCCGCCGCCCTACCTGAGGCCGCCATCCACGCCGGTTGAGTCGC<br>GTTCTGCCGCCTCCCGCCTGTGGTGCCTCCTGAACTGCGTCCGCCGTCTAGGTAAGT<br>TTAAAGCTCAGGTCGAGACCGGGCCTTTGTCCGGCGCTCCCTTGGAGCCTACCTAGA<br>CTCAGCCGGCTCTCCACGCTTTGCCTGACCCTGCTTGCTCAACTCTACGTCTTTGTTTC<br>GTTTTCTGTTCTGCGCCGTTACAGATCCAAGCTGTGACCGGCGCCTACTCTAGAGCTA<br>GCGAATTgccgccaccATGGTGAGCAAGGGCGAGGAGCTGTTCACCGGGGTGGTGCC<br>CATCCTGGTCGAGCTGGACGGCGACGTAAACGGCCACAAGTTCAGCGTGTCCGGCG | 2541 |

TABLE 5-continued

CONSTRUCTS USED FOR EVALUATION OF PREDICTED LOCI

| Construct name | Sequence | Length |
|---|---|---|
| | AGGGCGAGGGCGATGCCACCTACGGCAAGCTGACCCTGAAGTTCATCTGCACCACC<br>GGCAAGCTGCCCGTGCCCTGGCCCACCCTCGTGACCACCCTGACCTACGGCGTGCAG<br>TGCTTCAGCCGCTACCCCGACCACATGAAGCAGCACGACTTCTTCAAGTCCGCCATG<br>CCCGAAGGCTACGTCCAGGAGCGCACCATCTTCTTCAAGGACGACGGCAACTACAA<br>GACCCGCGCCGAGGTGAAGTTCGAGGGCGACACCCTGGTGAACCGCATCGAGCTG<br>AAGGGCATCGACTTCAAGGAGGACGGCAACATCCTGGGGCACAAGCTGGAGTACA<br>ACTACAACAGCCACAACGTCTATATCATGGCCGACAAGCAGAAGAACGGCATCAAG<br>GTGAACTTCAAGATCCGCCACAACATCGAGGACGGCAGCGTGCAGCTCGCCGACCA<br>CTACCAGCAGAACACCCCCATCGGCGACGGCCCCGTGCTGCTGCCCGACAACCACTA<br>CCTGAGCACCCAGTCCAAGCTGAGCAAAGACCCCAACGAGAAGCGCGATCACATGG<br>TCCTGCTGGAGTTCGTGACCGCCGCCGGGATCACTCTCGGCATGGACGAGCTGTAC<br>AAatgattgtttattgcagcttataatggttacaaataaagcaatagcatcacaaatttcacaaataaagcatt<br>ttttttcactgcattctagttgtggtttgtccaaactcatcaatgtatcttatGTGACGGTGCTGCGCAAGA<br>AGGGCCCTACGGCCGCCCAGGCCAAATCCAAGCAGGTGCTTTGCTGACTGAGGAGC<br>GGCCGGGCCGGGCGGGGCGGACGCTgggccggggccacggaccgtggggcaggggctcgggg<br>aagggcaggcggggcctgggacagggcgcaggggacggggacaaggctggGGTGCCGGGGGCAGG<br>ACGGGGTTCGAAGGGCGGGGCGAATCGCAGGGGTAGGAGGACCGGGCCAGGACa<br>ggggtgggaaggtgggggcggacccaggaggggatggacggacccaggaggcaggggGCGGGCGAC<br>TGGAGGAGGAGAGGAGCAGGGAACCGGACGGGGCAAGGGGCAGGCGATAGGGC<br>CGGGACCAGTGCCAGGGTGGGGCGGGGAGGGGATAGGGGCAGGGACTGTTGGTG<br>GGGACAGGTGTGAGGACAG (SEQ ID NO: 254) | |
| pARBI-650:<br>EDF1_2_Ex<br>ogenous_2<br>6 | ACGGCTAGAGCGGAGACCCCGCGCCCCCTCCGCCCGCGTGGCCCGGCCGGGGTGC<br>GGGGCCCGGGGAGGCACGGGGGCTGCGCGTCGGGGCGCAGCCGCCGCCCGCGTG<br>TGCTCGGAGGCCGCGGGGCCCGGGCTCCGGGTCCTCCCGACCTGCAGCCCCAGCG<br>GCTACCGCGCCTCGCCAGGCCAGGCCAGGCCCCGACGTCGCCTTCCCTACGTCGCCG<br>GCGCCCGGCCACGACGTCCCTCAGACGAGCCGAACGCCGAATGGCCCCGAGCACG<br>GGAAGTGCCCGCCCCCCGCGTGCAGCCAGCCAATGGGACGCCGAAAGCGGGGAGG<br>TGCCGAGGGGACGTAGCGTCGCCGCGCCAGGTCTCTAGCAGCTGCCGCTGAGCCGC<br>CGGACGGACGCTCGTCTTCGCCCGCCATGCCGAGAGCGACTGGGACACGGTGAC<br>GGTGCTGtgacgactgtgccttctagttgccagccatctgttgtttgccctccccgtgccttccttgaccctg<br>gaaggtgccactcccactgtcctttcctaataaaatgaggaaattgcatcgcattgtctgagtaggtgtcattct<br>attctgggggtggggtggggcaggacagcaaggggggaggattgggaagacaataggcaggcatgctgggga<br>tgcggtgggctctatggGGATCTGCGATCGCTCCGGTGCCCGTCAGTGGGCAGAGCGCAC<br>ATCGCCCACAGTCCCCGAGAAGTTGGGGGGAGGGGTCGGCAATTGAACGGGTGCC<br>TAGAGAAGGTGGCGCGGGGTAAACTGGGAAAGTGATGTCGTGTACTGGCTCCGCC<br>TTTTTCCCGAGGGTGGGGGAGAACCGTATATAAGTGCAGTAGTCGCCGTGAACGTT<br>CTTTTTCGCAACGGGTTTGCCGCCAGAACACAGCTGAAGCTTCGAGGGGCTCGCATC<br>TCTCCTTCACGCGCCCGCCGCCCTACCTGAGGCCGCCATCCACGCCGGTTGAGTCGC<br>GTTCTGCCGCCTCCCGCCTGTGGTGCCTCCTGAACTGCGTCCGCCGTCTAGGTAAGT<br>TTAAAGCTCAGGTCGAGACCGGGCCTTTGTCCGGCGCTCCCTTGGAGCCTACCTAGA<br>CTCAGCCGGCTCTCCACGCTTTGCCTGACCCTGCTTGCTCAACTCTACGTCTTTGTTTC<br>GTTTTCTGTTCTGCGCCGTTACAGATCCAAGCTGTGACCGGCGCCTACTCTAGAGCTA<br>GCGAATTgccgccaccATGGTGAGCAAGGGCGAGGAGCTGTTCACCGGGGTGGTGCC<br>CATCCTGGTCGAGCTGGACGGCGACGTAAACGGCCACAAGTTCAGCGTGTCCGGCG<br>AGGGCGAGGGCGATGCCACCTACGGCAAGCTGACCCTGAAGTTCATCTGCACCACC<br>GGCAAGCTGCCCGTGCCCTGGCCCACCCTCGTGACCACCCTGACCTACGGCGTGCAG<br>TGCTTCAGCCGCTACCCCGACCACATGAAGCAGCACGACTTCTTCAAGTCCGCCATG<br>CCCGAAGGCTACGTCCAGGAGCGCACCATCTTCTTCAAGGACGACGGCAACTACAA<br>GACCCGCGCCGAGGTGAAGTTCGAGGGCGACACCCTGGTGAACCGCATCGAGCTG<br>AAGGGCATCGACTTCAAGGAGGACGGCAACATCCTGGGGCACAAGCTGGAGTACA<br>ACTACAACAGCCACAACGTCTATATCATGGCCGACAAGCAGAAGAACGGCATCAAG<br>GTGAACTTCAAGATCCGCCACAACATCGAGGACGGCAGCGTGCAGCTCGCCGACCA<br>CTACCAGCAGAACACCCCCATCGGCGACGGCCCCGTGCTGCTGCCCGACAACCACTA<br>CCTGAGCACCCAGTCCAAGCTGAGCAAAGACCCCAACGAGAAGCGCGATCACATGG<br>TCCTGCTGGAGTTCGTGACCGCCGCCGGGATCACTCTCGGCATGGACGAGCTGTAC<br>AAatgattgtttattgcagcttataatggttacaaataaagcaatagcatcacaaatttcacaaataaagcatt<br>ttttttcactgcattctagttgtggtttgtccaaactcatcaatgtatcttatCGCAAGAAGGGCCCTACGG<br>CCGCCCAGGCCAAATCCAAGCAGGTGCTTTGCTGACTGAGGAGCGGCCGGGCCGG<br>GCGGGGCGGACGCTgggccggggccacggaccgtggggcaggggctcggggaagggcaggcgggg<br>cctgggacagggcgcaggggacggggacaaggctggGGTGCCGGGGGCAGGACGGGGTTCGA<br>AGGGCGGGGCGAATCGCAGGGGTAGGAGGACCGGGCCAGGACagggtgggaaggtg<br>ggggcgacccaggaggggatggacggacccaggaggcaggggCGGGCGACTGGAGGAGGA<br>GAGGAGCAGGGAACCGGACGGGGCAAGGGGCAGGCGATAGGGCCGGGACCAGT<br>GCCAGGGTGGGGCGGGGAGGGGATAGGGGCAGGGACTGTTGGTGGGGACAGGT<br>GTGAGGACAGAGGCAGGAGGTG (SEQ ID NO: 255) | 2541 |
| pARBI-651:<br>EDF1_3_Ex<br>ogenous_2<br>7 | CCCTGGAGTCGGTGTGAGGCAAAAGCAGAGGAGAGGATTTGGAATTAACCTGAAG<br>AAAAACCATTTCAAAGCGGTAACCAGACCCCAGAGGCTGCCTGAACTCAAGGGGAC<br>ATGGGAACCCAGGCTGTCCCAAGTTCACACACCTCAGGTCGTGACTTCCAGAGTTT<br>TCTCTCAGTTATGAGGACAGGCAGCTGTACTCATGCCAACCAGAGCTGCTCTGGGAA<br>GATGGCTGCCTCCCAGGGCTCCGGCCAGCACCGGTGCAGGCAGGCACTCAGCTGAC<br>AACGTCCCCGGGGCGCCGCACACACCACACCCACCAGCACATGGACCCCACAGCA<br>CAGCCTCATGTTGCAAGCGGAAACACAAGTACCTACATTTCTTGGAAGTCTCCACAT<br>CTTCTCCTCGTCTCTGTGCCGCTAAGATAGCCTAGAAAATTAGAAAACATCAGTGGtg | 2541 |

TABLE 5-continued

CONSTRUCTS USED FOR EVALUATION OF PREDICTED LOCI

| Construct name | Sequence | Length |
|---|---|---|
| | acgactgtgccttctagttgccagccatctgttgtttgcccctccccgtgccttccttgaccctggaaggtgccac<br>tcccactgtcctttcctaataaaatgaggaaattgcatcgcattgtctgagtaggtgtcattctattctgggggt<br>ggggtggggcaggacagcaaggggaggattgggaagacaatagcaggcatgctggggatgcggtgggctc<br>tatggGGATCTGCGATCGCTCCGGTGCCCGTCAGTGGGCAGAGCGCACATCGCCCAC<br>AGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatcttatTTTCTAAAGAGAAGATGTGCTTTATAC<br>ACATCAGCTCCACTAGGACTGCTGCAAAACCAGGCGCGAAGCGTCGCCTGAGAACA<br>GCAGCTTCTAGGGCCCCTGGGGTACGCACCCACACGCAGCTGGGTTTTGTGCGAGA<br>GGCAGTGAGAGCCGGGCTGACCTGGCTTCCCGAGGCATTCCCTGCAGGGGAACCA<br>GGGGGGTGGAGCCCACCCTCCCCGTGCTATCTGAACACCGGCCATCCCCCTCCCCAA<br>ACCCACAACCCCAGGAGTGAGAGCCCCGGCGCAGCCTCACCGTGGCCAGGTCCTTC<br>TGCGTAAGCCCCTTGCTCTGCCGACCTTGCTGGATCACCTTGCCCACCTCCAGGGTCA<br>CCCTGTCATGGTGCAGCTCCTCTGTCTCCCGGTCCAGCTTGGCCGTGTTCTTGGTAAT<br>AGAATGTTGTTTGTTCTGGCCAGCAGC (SEQ ID NO: 256) | |
| pARBI-652:<br>FTL_1_Exog<br>enous_28_<br>30 | CTCTTGCTTCAACAGTGTTTGGACGGAACAGATCCGGGGACTCTCTTCCAGCCTCCG<br>ACCGCCCTCCGATTTCCTCTCCGCTTGCAACCTCCGGGACCATCTTCTCGGCCATCTCC<br>TGCTTCTGGGACCTGCCAGCACCGTTTTTGTGGTTAGCTCCTTCTTGCCAACCAACCA<br>TGAGCTCCCAGATTCGTCAGAATTATTCCACCGACGTGGAGGCAGCCGTCAACAGCC<br>TGGTCAATTTGTACCTGCAGGCCTCCTACACCTACCTCTCTCTGGTGAGTCCCCAGGA<br>CGCCCCTGGCCCTAATTTCCTCAGCTGCGCACCTCCGGCCCTCACTGCACGCGCCAG<br>CCTTCTTTGTGCGGTCGGGTAAACAGAGGGCGGAGTCCCCTTGGCCTCGCCTCCCGC<br>TAACCATTGTTGCCTCCATCTCTTCCCGTAGGGCTTCTATTTCGACtgacgactgtgccttct<br>agttgccagccatctgttgtttgcccctccccgtgccttccttgaccctggaaggtgccactcccactgtcctttc<br>ctaataaaatgaggaaattgcatcgcattgtctgagtaggtgtcattctattctgggggtggggtggggcagg<br>acagcaaggggaggattgggaagacaatagcaggcatgctggggatgcggtgggctctatggGGATCT<br>GCGATCGCTCCGGTGCCCGTCAGTGGGCAGAGCGCACATCGCCCACAGTCCCCGAG<br>AAGTTGGGGGGAGGGGTCGGCAATTGAACGGGTGCCTAGAGAAGGTGGCGCGGG<br>GTAAACTGGGAAAGTGATGTCGTGTACTGGCTCCGCCTTMCCCGAGGGTGGGGG<br>AGAACCGTATATAAGTGCAGTAGTCGCCGTGAACGTTCTTTTTCGCAACGGGTTTGC<br>CGCCAGAACACAGCTGAAGCTTCGAGGGGCTCGCATCTCTCCTTCACGCGCCCGCCG<br>CCCTACCTGAGGCCGCCATCCACGCCGGTTGAGTCGCGTTCTGCCGCCTCCCGCCTG<br>TGGTGCCTCCTGAACTGCGTCCGCCGTCTAGGTAAGTTTAAAGCTCAGGTCGAGACC<br>GGGCCTTTGTCCGGCGCTCCCTTGGAGCCTACCTAGACTCAGCCGGCTCTCCACGCT<br>TTGCCTGACCCTGCTTGCTCAACTCTACGTCTTTGTTTCGTTTTCTGTTCTGCGCCGTT<br>ACAGATCCAAGCTGTGACCGGCGCCTACTCTAGAGCTAGCGAATTgccgccaccATGGT<br>GAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCA<br>CCTACGGCAAGCTGACCCTGAAGTTCATCTGCACCACCGGCAAGCTGCCCGTGCCCT<br>GGCCCACCCTCGTGACCACCCTGACCTACGGCGTGCAGTGCTTCAGCCGCTACCCCG<br>ACCACATGAAGCAGCACGACTTCTTCAAGTCCGCCATGCCCGAAGGCTACGTCCAGG<br>AGCGCACCATCTTCTTCAAGGACGACGGCAACTACAAGACCCGCGCCGAGGTGAAG<br>TTCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttttcactgcattctagttgtggtttgtcc<br>aaactcatcaatgtatcttatCGCGATGATGTGGCTCTGGAAGGCGTGAGCCACTTCTTCCG<br>CGAATTGGCCGAGGAGAAGCGCGAGGGCTACGAGCGTCCTGAAGATGCAAAAC<br>CAGCGTGGCGGCCGCGCTCTCTTCCAGGACATCAAGGTAACTAGTGTGTGGGTAAT | 2541 |

TABLE 5-continued

CONSTRUCTS USED FOR EVALUATION OF PREDICTED LOCI

| Construct name | Sequence | Length |
|---|---|---|
| | GGACTACATCTCCCAGCAGGCCGTGCGCGCGAGGAGCCTTGATTTGAGGGCGTAGG<br>TGTCGCGTGGGCTTCTGGGAGATTGAGTTCGGTCTTGTGAGCCCTCTTAACCGCTGG<br>AAATAGAGGCGCACCTCGTGCAGTGCCCACAACACGCGGCAGTCCACACCGCTGCG<br>TGGTCTTAGGGACGTATAGCTGTAAGAGCTAGGACAGGGTGCGGAGAGTGATAAA<br>TACAAGCTGTCACATGTCTTTGTGGCCTGGGCCTCTGACCCCCAACGACTCTTGGGA<br>AATGTAGGTTTAGTTCT (SEQ ID NO: 257) | |
| pARBI-653:<br>FTL_2_Exog<br>enous_29 | TGGGGCGGGGGGCTGAGACTCCTATGTGCTCCGGATTGGTCAGGCACGGCCTTCGG<br>CCCCGCCTCCTGCCACCGCAGATTGGCCGCTAGCCCTCCCCGAGCGCCCTGCCTCCG<br>AGGGCCGGCGCACCATAAAAGAAGCCGCCCTAGCCACGTCCCCTCGCAGTTCGGCG<br>GTCCCGCGGGTCTGTCTCTTGCTTCAACAGTGTTTGGACGGAACAGATCCGGGGACT<br>CTCTTCCAGCCTCCGACCGCCCTCCGATTTCCTCTCCGCTTGCAACCTCCGGGACCAT<br>CTTCTCGGCCATCTCCTGCTTCGGGACCTGCCAGCACCGTTTTTGTGGTTAGCTCCT<br>TCTTGCCAACCAACCATGAGCTCCCAGATTCGTCAGAATTATTCCACCGACGTGGAG<br>GCAGCCGTCAACAGCCTGGTCAATTTGTACCTGCAGGCCTCCTACACCTACtgacgact<br>gtgccttctagttgccagccatctgttgtttgccctccccgtgccttccttgaccctggaaggtgccactcccac<br>tgtcctttcctaataaaatgaggaaattgcatcgcattgtctgagtaggtgtcattctattctgggggtggggtg<br>gggcaggacagcaaggggggaggattgggaagacaatagcaggcatgctggggatgcggtgggctctatggG<br>GATCTGCGATCGCTCCGGTGCCCGTCAGTGGGCAGAGCGCACATCGCCCACAGTCC<br>CCGAGAAGTTGGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcatttttttcactgcattctagttg<br>tggtttgtccaaactcatcaatgtatcttatCTCTCTCTGGTGAGTCCCCAGGACGCCCCTGGCCC<br>TAATTTCCTCCAGCTGCGCACCTCCGGCCCTCACTGCACGCGCCAGCCTTCTTTGTGC<br>GGTCGGGTAAACAGAGGGCGGAGTCCCCTTGGCCTCGCCTCCCGCTAACCATTGTT<br>GCCTCCATCTCTTCCCGTAGGGCTTCTATTTCGACCGCGATGATGTGGCTCTGGAAG<br>GCGTGAGCCACTTCTTCCGCGAATTGGCCGAGGAGAAGCGCGAGGGCTACGAGCG<br>TCTCCTGAAGATGCAAAACCAGCGTGGCGGCCGCGCTCTCTTCCAGGACATCAAGGT<br>AACTAGTGTGTGGGTAATGGACTACATCTCCCAGCAGGCCGTGCGCGCGAGGAGCC<br>TTGATTTGAGGGCGTAGGTGTCGCGTGGGCTTCTGGGAGATTGAGTTCGGTCTTGT<br>GAGCCCTCTTAACCGCTGGA (SEQ ID NO: 258) | 2541 |
| pARB1-654:<br>PTENJ__Ex<br>ogenous_3<br>1 | CTTTGCATAGTTTATCCTATTAGTAATCTATTCTGTCTTTGGAATATGTTTTGTGATGA<br>TGAAATAAATACTATAAATAGTATTATTCCTTTTGCATTGAGAGTCCTGACGAAATGT<br>CCATGTGACAGTTCATTTTGGGTTTAGCTCTACCTCTAATATGTGACCTATGCTACCA<br>GTCCGTATAGCGTAAATTCCCAGAATATATCCTCCTGAATAAAATGGGGGAAAATAA<br>TACCTGGCTTCCTTAATGATTATATTTAAGACTTATCAAGAGACTATTTTCTATTTAAC<br>AATTAGAAAGTTAAGCAATACATTATTTTTCTCTGGAATCCAGTGTTTCTTTTAAATAC<br>CTGTTAAGTTTGTATGCAACATTTCTAAAGTTACCTACTTGTTAATTAAAAATTCAAG<br>AGTTTTTTTTCTTATTCTGAGGTTATCTTTTTACCACAGTTtgacgactgtgccttctagttgc<br>cagccatctgttgtttgccctccccgtgccttccttgaccctggaaggtgccactcccactgtcctttcctaata<br>aaatgaggaaattgcatcgcattgtctgagtaggtgtcattctattctgggggtggggtgggcaggacagca<br>agggggaggattgggaagacaatagcaggcatgctggggatgcggtgggctctatggGGATCTGCGAT<br>CGCTCCGGTGCCCGTCAGTGGGCAGAGCGCACATCGCCCACAGTCCCCGAGAAGTT<br>GGGGGGAGGGGTCGGCAATTGAACGGGTGCCTAGAGAAGGTGGCGCGGGGTAAA<br>CTGGGAAAGTGATGTCGTGTACTGGCTCCGCCTTTTTCCCGAGGGTGGGGGAGAAC<br>CGTATATAAGTGCAGTAGTCGCCGTGAACGTTCTTTTTCGCAACGGGTTTGCCGCCA<br>GAACACAGCTGAAGCTTCGAGGGGCTCGCATCTCTCCTTCACGCGCCCGCCGCCCTA<br>CCTGAGGCCGCCATCCACGCCGGTTGAGTCGCGTTCTGCCGCCTCCCGCCTGTGGTG<br>CCTCCTGAACTGCGTCCGCCGTCTAGGTAAGTTTAAAGCTCAGGTCGAGACCGGGCC<br>TTTGTCCGGCGCTCCCTTGGAGCCTACCTAGACTCAGCCGGCTCTCCACGCTTTGCCT<br>GACCCTGCTGCTCAACTCTACGTCTTTGTTTCGTTTTCTGTTCTGCGCCGTTACAGAT<br>CCAAGCTGTGACCGGCGCCTACTCTAGAGCTAGCGAATTgccgccaccATGGTGAGCA<br>AGGGCGAGGAGCTGTTCACCGGGGTGGTGCCCATCCTGGTCGAGCTGGACGGCGA<br>CGTAAACGGCCACAAGTTCAGCGTGTCCGGCGAGGGCGAGGGCGATGCCACCTAC | 2541 |

TABLE 5-continued

CONSTRUCTS USED FOR EVALUATION OF PREDICTED LOCI

| Construct name | Sequence | Length |
|---|---|---|
| | GGCAAGCTGACCCTGAAGTTCATCTGCACCACCGGCAAGCTGCCCGTGCCCTGGCCC<br>ACCCTCGTGACCACCCTGACCTACGGCGTGCAGTGCTTCAGCCGCTACCCCGACCAC<br>ATGAAGCAGCACGACTTCTTCAAGTCCGCCATGCCCGAAGGCTACGTCCAGGAGCG<br>CACCATCTTCTTCAAGGACGACGGCAACTACAAGACCCGCGCCGAGGTGAAGTTCG<br>AGGGCGACACCCTGGTGAACCGCATCGAGCTGAAGGGCATCGACTTCAAGGAGGA<br>CGGCAACATCCTGGGGCACAAGCTGGAGTACAACTACAACAGCCACAACGTCTATA<br>TCATGGCCGACAAGCAGAAGAACGGCATCAAGGTGAACTTCAAGATCCGCCACAAC<br>ATCGAGGACGGCAGCGTGCAGCTCGCCGACCACTACCAGCAGAACACCCCCATCGG<br>CGACGGCCCCGTGCTGCTGCCCGACAACCACTACCTGAGCACCCAGTCCAAGCTGA<br>GCAAAGACCCCAACGAGAAGCGCGATCACATGGTCCTGCTGGAGTTCGTGACCGCC<br>GCCGGGATCACTCTCGGCATGGACGAGCTGTACAAatgattgtttattgcagcttataatggtt<br>acaaataaagcaatagcatcacaaatttcacaaataaagcattttttcactgcattctagttgtggtttgtccaa<br>actcatcaatgtatcttatGCAATATCCTTTTGAAGACCATAACCCACCACAGCTAGAAC<br>TTATCAAACCCTTTTGTGAAGATCTTGACCAATGGCTAAGTGAAGATGACAATCATG<br>TTGCAGCAATTCACTGTAAAGCTGGAAAGGGACGAACTGGTGTAATGATATGTGCA<br>TATTTATTACATCGGGGCAAATTTTTAAAGGCACAAGAGGCCCTAGATTTCTATGGG<br>GAAGTAAGGACCAGAGACAAAAAGGTAAGTTATTTTTTGATGTTTTTCCTTTCCTCTT<br>CCTGGATCTGAGAATTTATTGGAAAACAGATTTTGGGTTTCTTTTTTTCCTTCAGTTTT<br>ATTGAGGTGTAATTGACAAGTAAAAATTATATATAAATACAATGTATAATATGATGT<br>TTTGATGTATGTGTATATACATTGTGAAATGATTACTACAGTCAAACTACTTAACATA<br>TTCAT (SEQ ID NO: 259) | |
| pARBI-655:<br>PTEN_2_Ex<br>ogenous_3 | GCTACCAGTCCGTATAGCGTAAATTCCCAGAATATATCCTCCTGAATAAAATGGGGG<br>AAAATAATACCTGGCTTCCTTAATGATTATATTTAAGACTTATCAAGAGACTATTTTCT<br>ATTTAACAATTAGAAAGTTAAGCAATACATTATTTTTCTCTGGAATCCAGTGTTTCTTT<br>21AATACCTGTTAAGTTTGTATGCAACATTTCTAAAGTTACCTACTTGTTAATTAAAA<br>ATTCAAGAGTTTTTTTTTCTTATTCTGAGGTTATCTTTTTACCACAGTTGCACAATATC<br>CTTTTGAAGACCATAACCCACCACAGCTAGAACTTATCAAACCCTTTTGTGAAGATCT<br>TGACCAATGGCTAAGTGAAGATGACAATCATGTTGCAGCAATTCACTGTAAAGCTG<br>GAAAGGGACGAACTGGTGTAATGATATGTGCATATTTATTACATtgacgactgtgccttct<br>agttgccagccatctgttgtttgccccctccccgtgccttccttgacctggaaggtgccactcccactgtcctttc<br>ctaataaaatgaggaaattgcatcgcattgtctgagtaggtgtcattctattctgggggtggggtgggcagg<br>acagcaagggggaggattgggaagacaatagcaggcatgctggggatgcggtgggctctatggGGATCT<br>GCGATCGCTCCGGTGCCCGTCAGTGGGCAGAGCGCACATCGCCCACAGTCCCCGAG<br>AAGTTGGGGGGAGGGGTCGGCAATTGAACGGGTGCCTAGAGAAGGTGGCGCGGG<br>GTAAACTGGGAAAGTGATGTCGTGTACTGGCTCCGCCTTTTTCCCGAGGGTGGGGG<br>AGAACCGTATATAAGTGCAGTAGTCGCCGTGAACGTTCTTTTTTCGCAACGGGTTTGC<br>CGCCAGAACACAGCTGAAGCTTCGAGGGGCTCGCATCTCTCCTTCACGCGCCCGCCG<br>CCCTACCTGAGGCCGCCATCCACGCCGGTTGAGTCGCGTTCTGCCGCCTCCCGCTG<br>TGGTGCCTCCTGAACTGCGTCCGCCGTCTAGGTAAGTTTAAAGCTCAGGTCGAGACC<br>GGGCCTTTGTCCGGCGCTCCCTTGGAGCCTACCTAGACTCAGCCGGCTCTCCACGCT<br>TTGCCTGACCCTGCTTGCTCAACTCTACGTCTTTGTTTCGTTTTTCTGTTCTGCGCCGTT<br>ACAGATCCAAGCTGTGACCGGCGCCTACTCTAGAGCTAGCGAATTgccgccaccATGGT<br>GAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCA<br>CCTACGGCAAGCTGACCCTGAAGTTCATCTGCACCACCGGCAAGCTGCCCGTGCCCT<br>GGCCCACCCTCGTGACCACCCTGACCTACGGCGTGCAGTGCTTCAGCCGCTACCCCG<br>ACCACATGAAGCAGCACGACTTCTTCAAGTCCGCCATGCCCGAAGGCTACGTCCAGG<br>AGCGCACCATCTTCTTCAAGGACGACGGCAACTACAAGACCCGCGCCGAGGTGAAG<br>TTCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatCGGGGCAAATTTTTAAAGGCACAAGAGGCCCTAGATTTCTA<br>TGGGGAAGTAAGGACCAGAGACAAAAAGGTAAGTTATTTTTTGATGTTMCCTTTC<br>CTCTTCCTGGATCTGAGAATTTATTGGAAAACAGATTTTGGGTTTCTTTTTTTCCTTCA<br>GTTTTATTGAGGTGTAATTGACAAGTAAAAATTATATATAAATACAATGTATAATATG<br>ATGTTTTGATGTATGTGTATATACATTGTGAAATGATTACTACAGTCAAACTACTTAA<br>CATATTCATCACCTCACATAATTATTATTCTCCCCCCAGGGTGAAAGCATTTAAGATC<br>TACAAGCTACAATTTTCAATTATACAATGTTATTATTAACTATAGTCACTATGCTGTCC<br>AGTAGAGCTTCAGATCTTGTTCATCTTGTGTTCCTCCCTCCCCACCCTCAGTCCCTGGA<br>A (SEQ ID NO: 260) | 2541 |
| pARBI-656:<br>PTEN_3_Ex<br>ogenous_3 | ATAAATAGTATTATTCCTTTTGCATTGAGAGTCCTGACGAAATGTCCATGTGACAGTT<br>CATTTTGGGTTTAGCTCTACCTCTAATATGTGACCTATGCTACCAGTCCGTATAGCGT<br>AAATTCCCAGAATATATCCTCCTGAATAAAATGGGGGAAAATAATACCTGGCTTCCT<br>31AATGATTATATTTAAGACTTATCAAGAGACTATTTTCTATTTAACAATTAGAAAGTT<br>AAGCAATACATTATTTTTCTCTGGAATCCAGTGTTTCTTTTAAATACCTGTTAAGTTTG<br>TATGCAACATTTCTAAAGTTACCTACTTGTTAATTAAAAATTCAAGAGTTTTTTTTTCT<br>TATTCTGAGGTTATCTTTTTACCACAGTTGCACAATATCCTTTTGAAGACCATAACCCA<br>CCACAGCTAGAACTTATCAAACCCTTTTGTGAAGATCTTGACtgacgactgtgccttctagtt | 2541 |

TABLE 5-continued

CONSTRUCTS USED FOR EVALUATION OF PREDICTED LOCI

| Construct name | Sequence | Length |
|---|---|---|
| | gccagccatctgttgtttgcccctccccgtgccttccttgaccctggaaggtgccactcccactgtcctttcctaa<br>taaaatgaggaaattgcatcgcattgtctgagtaggtgtcattctattctggggggtggggtggggcaggacag<br>caagggggaggattgggaagacaatagcaggcatgctggggatgcggtgggctctatgGGATCTGCGA<br>TCGCTCCGGTGCCCGTCAGTGGGCAGAGCGCACATCGCCCACAGTCCCCGAGAAGT<br>TGGGGGGAGGGGTCGGCAATTGAACGGGTGCCTAGAGAAGGTGGCGCGGGGTAA<br>ACTGGGAAAGTGATGTCGTGTACTGGCTCCGCCTTMCCCGAGGGTGGGGGAGAA<br>CCGTATATAAGTGCAGTAGTCGCCGTGAACGTTCTTTTTCGCAACGGGTTTGCCGCC<br>AGAACACAGCTGAAGCTTCGAGGGGCTCGCATCTCTCCTTCACGCGCCCGCCGCCCT<br>ACCTGAGGCCGCCATCCACGCCGGTTGAGTCGCGTTCTGCCGCCTCCCGCCTGTGGT<br>GCCTCCTGAACTGCGTCCGCCGTCTAGGTAAGTTTAAAGCTCAGGTCGAGACCGGG<br>CCTTTGTCCGGCGCTCCCTTGGAGCCTACCTAGACTCAGCCGGCTCTCCACGCTTTGC<br>CTGACCCTGCTTGCTCAACTCTACGTCTTTGMCGTTTTCTGTTCTGCGCCGTTACAG<br>ATCCAAGCTGTGACCGGCGCCTACTCTAGAGCTAGCGAATTgccgccaccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatCAATGGCTAAGTGAAGATGACAATCATGTTGCAGCAATTCA<br>CTGTAAAGCTGGAAAGGGACGAACTGGTGTAATGATATGTGCATATTTATTACATCG<br>GGGCAAATTTTTAAAGGCACAAGAGGCCCTAGATTTCTATGGGGAAGTAAGGACCA<br>GAGACAAAAAGGTAAGTTATTTTTTGATGTTTTTCCTTTCCTCTTCCTGGATCTGAGA<br>ATTTATTGGAAAACAGATTTTGGGTTTCTTTTMCCTTCAGTTTTATTGAGGTGTAAT<br>TGACAAGTAAAAATTATATATAAATACAATGTATAATATGATGTTTTGATGTATGTGT<br>ATATACATTGTGAAATGATTACTACAGTCAAACTACTTAACATATTCATCACCTCACA<br>TAATTATTATTCTCCCCCCAGGGTGAAAGCATTTAAGATCTACAAGCTACAATTTTCA<br>ATTAT (SEQ ID NO: 261) | |
| pARBI-657:<br>PTPN2_1_E<br>xogenous_3<br>4 | TAGTGACGGTATCAAGAGCAGCATCCCAGGTTGACTTTCTTTGGGGCAGGACCTTGC<br>TTGTGTCTTAACCCTTGGTTCCTACCcaagtttgtctctctagtcctcaactctgaaagccacttgatat<br>cttacacaattccttttttgcctgagaaaataaaagtcagttttgatcatttacaaccaaaaatcctaactaacac<br>aGACCTGTTTTTGAAATCAGGTAGATTGGAAGTCTTGGTTTACTTCTTTATAAGCCCGT<br>CCGCTGTCTGTCTTGTAACATCCCAGGAGCAGACTTAACAAGGCCTTCCTGGAGCCT<br>TGCTCTTTCTGTCTGCTTCCCTCATCTGctctctctcctctctctTCACAGGGTCCACTTCCTA<br>ACACATGCTGCCATTTCTGGCTTATGGTTTGGCAGCAGAAGACCAAAGCAGTTGTCA<br>TGCTGAACCGCTgacgactgtgccttctagttgccagccatctgttgtttgcccctccccgtgccttccttga<br>ccctggaaggtgccactcccactgtcctttcctaataaaatgaggaaattgcatcgcattgtctgagtaggtgtc<br>attctattctggggggtggggtggggcaggacagcaaggggaggattgggaagacaatagcaggcatgctg<br>gggatgcggtgggctctatgGGATCTGCGATCGCTCCGGTGCCCGTCAGTGGGCAGAGCG<br>CACATCGCCCACAGTCCCCGAGAAGTTGGGGGGAGGGGTCGGCAATTGAACGGGT<br>GCCTAGAGAAGGTGGCGCGGGGTAAACTGGGAAAGTGATGTCGTGTACTGGCTCC<br>GCCTTTTTCCCGAGGGTGGGGGAGAACCGTATATAAGTGCAGTAGTCGCCGTGAAC<br>GTTCTTTTTCGCAACGGGTTTGCCGCCAGAACACAGCTGAAGCTTCGAGGGGCTCGC<br>ATCTCTCCTTCACGCGCCCGCCGCCCTACCTGAGGCCGCCATCCACGCCGGTTGAGT<br>CGCGTTCTGCCGCCTCCCGCCTGTGGTGCCTCCTGAACTGCGTCCGCCGTCTAGGTA<br>AGTTTAAAGCTCAGGTCGAGACCGGGCCTTTGTCCGGCGCTCCCTTGGAGCCTACCT<br>AGACTCAGCCGGCTCTCCACGCTTTGCCTGACCCTGCTTGCTCAACTCTACGTCTTTG<br>TTTCGTTTTCTGTTCTGCGCCGTTACAGATCCAAGCTGTGACCGGCGCCTACTCTAGA<br>GCTAGCGAATTgccgccaccATGGTGAGCAAGGGCGAGGAGCTGTTCACCGGGGTGG<br>TGCCCATCCTGGTCGAGCTGGACGGCGACGTAAACGGCCACAAGTTCAGCGTGTCC<br>GGCGAGGGCGAGGGCGATGCCACCTACGGCAAGCTGACCCTGAAGTTCATCTGCAC<br>CACCGGCAAGCTGCCCGTGCCCTGGCCCACCCTCGTGACCACCCTGACCTACGGCGT<br>GCAGTGCTTCAGCCGCTACCCCGACCACATGAAGCAGCACGACTTCTTCAAGTCCGC<br>CATGCCCGAAGGCTACGTCCAGGAGCGCACCATCTTCTTCAAGGACGACGGCAACT<br>ACAAGACCCGCGCCGAGGTGAAGTTCGAGGGCGACACCCTGGTGAACCGCATCGA<br>GCTGAAGGGCATCGACTTCAAGGAGGACGGCAACATCCTGGGGCACAAGCTGGAG<br>TACAACTACAACAGCCACAACGTCTATATCATGGCCGACAAGCAGAAGAACGGCAT<br>CAAGGTGAACTTCAAGATCCGCCACAACATCGAGGACGGCAGCGTGCAGCTCGCCG<br>ACCACTACCAGCAGAACACCCCCATCGGCGACGGCCCCGTGCTGCTGCCCGACAACC<br>ACTACCTGAGCACCCAGTCCAAGCTGAGCAAAGACCCCAACGAGAAGCGCGATCAC<br>ATGGTCCTGCTGGAGTTCGTGACCGCCGCCGGGATCACTCTCGGCATGGACGAGCT<br>GTACAAatgattgtttattgcagcttataatggttacaaataaagcaatagcatcacaaatttcacaaataaa<br>gcattttttcactgcattctagttgtggtttgtccaaactcatcaatgtatcttatATTGTGGAGAAAGAA<br>TCGGTGAGTAATATTTAATATTTACAACTTAGTATACTGTATGTGATCATTAGCATAT<br>AAAGATTTTCATTTTGGGGCAATATTCATTCCTTAGTTTTGGCCTTTAATTGCTAAAG<br>GCTAGCGGTCAAAGTGTTTCTGTCCGGAAAAACTCATGTATCCTTTTCCTTTCTTAAG | 2541 |

TABLE 5-continued

CONSTRUCTS USED FOR EVALUATION OF PREDICTED LOCI

| Construct name | Sequence | Length |
| --- | --- | --- |
| | TATTTTTATAACAATTGCAGACCTTTCATCTCCAAGATAGAAATACAATGGAATAAAT<br>ATGGACTAGCAGTGACATATAGATCTTTGGAATCCCTAGGAATCCTTATTGACCTATT<br>GTCAATAAGTCCTCTTCCAGCTTTAAGATCTTGTACTGTTCTACTTCAGATTTCTTACT<br>TTATTCTACATTTCATAATTGCTGGTTTTTAATGATGATGAAAATTTCCTAATCCACTT<br>CTAATTAGATGTGGCAATGACATGCC (SEQ ID NO: 262) | |
| pARBI-658:<br>PTPN2_2_E<br>xogenous_3 | CAGAATTTGAATATGATGTGGCTGACCATAGATACCTCCATTGCATTAATTCTGCTTC<br>ATAAAGTGTTTGATGCTTGCTTGTAGGTGTTGAATAGAGCCTAATTAGCAGTAAGTA<br>AACAGATCTagagcacagactttggcatctgaaggaccttggttcaatgctgggactgccacttactagcta<br>5tgggatctttggtggattttttaacctttgaaagcctttcatccctcacagatataatgggggaagaaaatcgtttcc<br>attagtattgtgaggattaaatgattaattgatgtaaacaatgtgctttccatagtacttggcatatcataagtgc<br>ttcatgTTATTTTACGCTGGCTGGGAAGATAAGTTTTGCTGTGGAGAATTTAAGAGGG<br>ATATTAAAATATATTTTTGTTATTTTAAGGAAATTCGAAATGAGTCCCATGACtgacgac<br>tgtgccttctagttgccagccatctgttgtttgccctcccccgtgccttccttgaccctggaaggtgccactccca<br>ctgtcctttcctaataaaatgaggaaattgcatcgcattgtctgagtaggtgtcattctattctgggggtggggt<br>ggggcaggacagcaaggggggaggattgggaagacaatagcaggcatgctggggatgcggtgggctctatgg<br>GGATCTGCGATCGCTCCGGTGCCCGTCAGTGGGCAGAGCGCACATCGCCCACAGTC<br>CCCGAGAAGTTGGGGGGAGGGGTCGGCAATTGAACGGGTGCCTAGAGAAGGTGG<br>CGCGGGGTAAACTGGGAAAGTGATGTCGTGTACTGGCTCCGCCTTTTTCCCGAGGG<br>TGGGGGAGAACCGTATATAAGTGCAGTAGTCGCCGTGAACGTTCTTTTTCGCAACG<br>GGTTTGCCGCCAGAACACAGCTGAAGCTTCGAGGGGCTCGCATCTCTCCTTCACGCG<br>CCCGCCGCCTACCTGAGGCCGCCATCCACGCCGGTTGAGTCGCGTTCTGCCGCCTC<br>CCGCCTGTGGTGCCTCCTGAACTGCGTCCGCCGTCTAGGTAAGTTTAAAGCTCAGGT<br>CGAGACCGGGCCTTTGTCCGGCGCTCCCTTGGAGCCTACCTAGACTCAGCCGGCTCT<br>CCACGCTTTGCCTGACCCTGCTTGCTCAACTCTACGTCTTTGTTTCGTTTTCTGTTCTG<br>CGCCGTTACAGATCCAAGCTGTGACCGGCGCCTACTCTAGAGCTAGCGAATTgccgcc<br>accATGGTGAGCAAGGGCGAGGAGCTGTTCACCGGGGTGGTGCCCATCCTGGTCGA<br>GCTGGACGGCGACGTAAACGGCCACAAGTTCAGCGTGTCCGGCGAGGGCGAGGGC<br>GATGCCACCTACGGCAAGCTGACCCTGAAGTTCATCTGCACCACCGGCAAGCTGCCC<br>GTGCCCTGGCCCACCCTCGTGACCACCCTGACCTACGGCGTGCAGTGCTTCAGCCGC<br>TACCCCGACCACATGAAGCAGCACGACTTCTTCAAGTCCGCCATGCCCGAAGGCTAC<br>GTCCAGGAGCGCACCATCTTCTTCAAGGACGACGGCAACTACAAGACCCGCGCCGA<br>GGTGAAGTTCGAGGGCGACACCCTGGTGAACCGCATCGAGCTGAAGGGCATCGAC<br>TTCAAGGAGGACGGCAACATCCTGGGGCACAAGCTGGAGTACAACTACAACAGCCA<br>CAACGTCTATATCATGGCCGACAAGCAGAAGAACGGCATCAAGGTGAACTTCAAGA<br>TCCGCCACAACATCGAGGACGGCAGCGTGCAGCTCGCCGACCACTACCAGCAGAAC<br>ACCCCCATCGGCGACGGCCCCGTGCTGCTGCCCGACAACCACTACCTGAGCACCCAG<br>TCCAAGCTGAGCAAAGACCCCAACGAGAAGCGCGATCACATGGTCCTGCTGGAGTT<br>CGTGACCGCCGCCGGGATCACTCTCGGCATGGACGAGCTGTACAAAatgattgtttattgca<br>gcttataatggttacaaataaagcaatagcatcacaaatttcacaaataaagcattttttcactgcattctagtt<br>gtggtttgtccaaactcatcaatgtatcttatTATCCTCATAGAGTGGCCAAGTTTCCAGAAAACA<br>GAAATCGAAACAGATACAGAGATGTAAGCCCATGTAAGTACTTGTGGGTTTGTGTG<br>CATGTGTATTTTTTGGTTTGTTTAGGAGGCAGGATGTAGTGAAAAGGAGGGCTTG<br>GGGTCAGTGTTGATAAATACAGTAATTTTTTTCCTATTTACGTAAGACACGTTCTTTA<br>AGAATTTAAAGGTGTAGAATAGTGGAAGGAAAAATAATTACCCATAATTATTTCATC<br>CTTCAAACATAGGCACCATTATTTTGGTGTATTTCCCACAACCTGTTTTTCTTATGCAC<br>AGTTTTCCTTTCTTTAAAATAATTGTAATTATAGATGTCTATATAATATCCATATGTAT<br>TTCCTTTTCATATCATTCCATCCCCTTTGTAAGTTTTGCTTAAAATAGTTATTGGTGTA<br>GTTTGGTTTTTT (SEQ ID NO: 263) | 2541 |
| pARBI-659:<br>PTPN2_3_E<br>xogenous_3<br>6 | ACCAGTTATCGTTTGTAGGTAGACCAATCAATTCTTAGGTACCAAGAATCTGAATG<br>ATCCTTTTACTTTTAGGAAGGTAAGTACTTTATTCATTTAACTATGTTTACTCCTGGTC<br>GATTTTTCAAGTCACAATGGCTAATGTGCTACAAACAGAAGTGCTTCCTTTCCAGCAC<br>TATAGTAATAAACAAGATTGCATTTTATACTCCTTACAAAAAAGTAGAGAATAGTTT<br>AGGATTTGTCTCAACTCTATTATGATGCTAATTCATTTTTCTTATTCTTCTGTCTTTTT<br>ATAAATACCTAGAATATTAATATGAAGATAAAAACAGTAATTTTGAAATGACAGTTG<br>TGGTTTATCATTCTCTATTTTCAGATGATCACAGTCGTGTTAAACTGCAAAATGCTGA<br>GAATGATTATATTAATGCCAGTTTAGTTGACATAGAAGAGGCAtgacgactgtgccttctag<br>ttgccagccatctgttgtttgccctcccccgtgccttccttgaccctggaaggtgccactcccactgtcctttcct<br>aataaaatgaggaaattgcatcgcattgtctgagtaggtgtcattctattctgggggtggggtggggcaggac<br>agcaaggggaggattgggaagacaatagcaggcatgctggggatgcggtgggctctatggGGATCTGC<br>GATCGCTCCGGTGCCCGTCAGTGGGCAGAGCGCACATCGCCCACAGTCCCCGAGAA<br>GTTGGGGGGAGGGGTCGGCAATTGAACGGGTGCCTAGAGAAGGTGGCGCGGGGT<br>AAACTGGGAAAGTGATGTCGTGTACTGGCTCCGCCTTTTTCCCGAGGGTGGGGGAG<br>AACCGTATATAAGTGCAGTAGTCGCCGTGAACGTTCTTTTTCGCAACGGGTTTGCCG<br>CCAGAACACAGCTGAAGCTTCGAGGGGCTCGCATCTCTCCTTCACGCGCCCGCCGCC<br>CTACCTGAGGCCGCCATCCACGCCGGTTGAGTCGCGTTCTGCCGCCTCCCGCCTGTG<br>GTGCCTCCTGAACTGCGTCCGCCGTCTAGGTAAGTTTAAAGCTCAGGTCGAGACCGG<br>GCCTTTGTCCGGCGCTCCCTTGGAGCCTACCTAGACTCAGCCGGCTCTCCACGCMG<br>CCTGACCCTGCTTGCTCAACTCTACGTCTTTGTTTCGTTTTCTGTTCTGCGCCGTTACA<br>GATCCAAGCTGTGACCGGCGCCTACTCTAGAGCTAGCGAATTgccgccaccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC | 2541 |

TABLE 5-continued

CONSTRUCTS USED FOR EVALUATION OF PREDICTED LOCI

| Construct name | Sequence | Length |
|---|---|---|
| | CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAtgattgtttattgcagcttataatgg<br>ttacaaataaagcaatagcatcacaaatttcacaaataaagcatttttttcactgcattctagttgtggtttgtcc<br>aaactcatcaatgtatcttatCAAAGGAGTTACATCTTAACACAGGCAAGTAATACGATACC<br>ACGCAAATGTCTGAAAATGATGTGTTTGTGCTTGTTCTGCTTTAAATCATAGGTAAAA<br>GTATATCTTGACTTCTTTTGGAAATGAAATGGTATTTCAGTTTTTTTCTGACGATGTAA<br>TGAATTATGGACATTATAAGGTTTTGAAGCTTTGAGTATTTAAGATAAAAGGCAAGT<br>TATTTTTGATATTACACGTTCTGTGAAGGAAAATTCTTAGGAAATGGCTTAGGCCAG<br>TTCTTTGGCAGATTGTGTTCCTTACATTATATCTGACACAGAGTGCTGCTTATGCTTCT<br>TAGTGTCTTCTTTTCTCTTCCCATACCCTGTGGCAAAACCAGAGGCCCTGGACAGCTC<br>TTCTGTAGCTCCCCCTGCCTCGCATATATCTTCAGAGAGTACACCAAGCCCTGGATGG<br>TGT (SEQ ID NO: 264) | |
| pARBI-660:<br>PTPN6_1_E<br>xogenous_3<br>7 | CCTGCTCAAGGGCCGAGGTGTCCACGGTAGCTTCCTGGCTCGGCCCAGTCGCAAGA<br>ACCAGGGTGACTTCTCGCTCTCCGTCAGGTAGGTGGGCCCCCCGCAACCCCGGGCAT<br>TTTGGCCACTCTCTTGTGCCATCCAGGCCCTGAACCACTCATTCCTGGTTCCCCGTGG<br>CAGTGCTGACTCCCCGTCTGTTCCCTTGCCCCCAACCCCCACACTCCCCATCCCTGTCT<br>GTGCCCACCCATGCCCATGTGTGCCCCCACCCAGGACCTCAGCCGATCCCTGCCCTCC<br>TGCCTCTACTCCTGCACCGACTGGCCTCACCGCCTGGTGCCCTGCAGGGTGGGGGAT<br>CAGGTGACCCATATTCGGATCCAGAACTCAGGGGATTTCTATGACCTGTATGGAGG<br>GGAGAAGTTTGCGACTCTGACAGAGCTGGTGGAGTACTACACTCAGCAGtgacgactg<br>tgccttctagttgccagccatctgttgtttgccctccccgtgccttccttgaccctggaaggtgccactcccact<br>gtcctttcctaataaaatgaggaaattgcatcgcattgtctgagtaggtgtcattctattctgggggtggggtg<br>gggcaggacagcaagggggaggattgggaagacaatagcaggcatgctgggatgcggtgggctctatggG<br>GATCTGCGATCGCTCCGGTGCCCGTCAGTGGGCAGAGCGCACATCGCCCACAGTCC<br>CCGAGAAGTTGGGGGGAGGGGTCGGCAATTGAACGGGTGCCTAGAGAAGGTGGC<br>GCGGGGTAAACTGGGAAAGTGATGTCGTGTACTGGCTCCGCCTTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAAtgattgtttattgcag<br>cttataatggttacaaataaagcaatagcatcacaaatttcacaaataaagcatttttttcactgcattctagttg<br>tggtttgtccaaactcatcaatgtatcttatCAGGGTGTCCTGCAGGACCGCGACGGCACCATCA<br>TCCACCTCAAGTACCCGCTGAACTGCTCCGATCCCACTAGTGAGAGGTGAGGGCTCC<br>GCACCCCCGCCATTCCCAAGCAGGGATGAGCCGGCTCCCACCCTGAACAGCCAGGG<br>AGGCAGGGAGACTGGCAGCCGGCGCTGCCTACCCTCCATCCCCTCCCCTCCCTGCAC<br>CAGCTGGGCTCTCAATGTCCCTCCTCCCTGCTGTCCTGGGACCTGGTGTCTCAGAG<br>CCTAACCTACCACCCTTTCCACCTAACCCCGAGGAAGCCACAGAAAGCTGCCTCGCC<br>CTACTCCGGGAGCCCTGGCCGCTGCAACCCAGGTCCCACTGGAGACAGGGAGGCCA<br>CTGCTGGTGGCCAGCATGTCGTGCAGGCCAGCTCTGTTGTTAGAAAGCTCTTCTTCC<br>TCTGGAATCGAGCCTGCCT (SEQ ID NO: 265) | 2541 |
| pARBI-661:<br>PTPN6_2_E<br>xogenous_3<br>8 | CTGGGTTCGAAGCCCGGTTAGAACTCTGGAGGCTAGGATGGCTTGAACCTGGGAGG<br>TCGAGGCTGCAGAGAGCTGTAACCGCGCCACTGCACTCCAGCCTGGGCAACAGAGC<br>TCTGGAAGCTTGCCCTAGAGTCAGTCAAGGGCCCTAGGCCAGTGAGTAACAGCTCA<br>GCGTCAGTTTCCTCATCTATAAAATGGGGGTAATATCATACCTAGCTCTCAGCATGTT<br>TGTGAGAGACCTAAATGAGGTGGTGGATTTGGAAGCATGTAGCGCAGTTGCCTGGCA<br>CACAGTAGGTGCTTGATTTCCGGCCCCTCTCTGTGAATGTCTCTGCTCAGCGCCTTCC<br>CCTGTGGCCTGGGTCTTACCTTCCCTGACGCTGCCTTCTCTAGGTGGTACCATGGCCA<br>CATGTCTGGCGGGCAGGCAGAGACGCTGCTGCAGGCCAAGGGCGAGCCCTGGtgac<br>gactgtgccttctagttgccagccatctgttgtttgccctccccgtgccttccttgaccctggaaggtgccactc<br>ccactgtcctttcctaataaaatgaggaaattgcatcgcattgtctgagtaggtgtcattctattctgggggtgg | 2541 |

TABLE 5-continued

CONSTRUCTS USED FOR EVALUATION OF PREDICTED LOCI

| Construct name | Sequence | Length |
|---|---|---|
| | ggtggggcaggacagcaaggggaggattgggaagacaatagcaggcatgctggggatgcggtgggctcta<br>tggGGATCTGCGATCGCTCCGGTGCCCGTCAGTGGGCAGAGCGCACATCGCCCACAG<br>TCCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcatttttttcactgcattctag<br>ttgtggttttgtccaaactcatcaatgtatcttatACGTTTCTTGTGCGTGAGAGCCTCAGCCAGCC<br>TGGAGACTTCGTGCTTTCTGTGCTCAGTGACCAGCCCAAGGCTGGCCCAGGCTCCCC<br>GCTCAGGGTCACCCACATCAAGGTCATGTGCGAGGTAAGGCAGCCAGGCGGCGGG<br>GGAGCCTCTGCTGAGGCTCCTGTCTGTGACCACAGTGTGGGTGGCAGGGAGGGTCT<br>GCCTGGGCTTGAATTCAAGGCTGGGGACCCAGGGAGGGGAGACTCAAGTCCTGTGA<br>ATGGCCTAATTTGGCTCCCCCCAGGGTGGACGCTACACAGTGGGTGGTTTGGAGAC<br>CTTCGACAGCCTCACGGACCTGGTGGAGCATTTCAAGAAGACGGGGATTGAGGAG<br>GCCTCAGGCGCCTTTGTCTACCTGCGGCAGGTCAGGGGTGGGCCCAGCTGCCTCCCC<br>ACTTCCCCTGAGCTGTCCCCCAGATGT (SEQ ID NO: 266) | |
| pARBI-662:<br>PTPN6_3_E<br>xogenous_3<br>9 | TGTCACATATGTGCAATGCCATGCTCCTGAGCCTTTGATTGCAGACGTGTGGGAAGT<br>GGGCCCCGTCCCCACCCCCAGTGCCACCCTGCTCTGCTTCTTCCCTTGCTGTGCTCT<br>AAAACGAGAAGTACAAGTGAGTTCCCCCAAGGGGTCGGCCGCGCCTCTTCCTGTCC<br>CCGCCCTGCCGGCTGCCCCAGGCCAGTGGAGTGGCAGCCCCAGAACTGGGACCACC<br>GGGGGTGGTGAGGCGGCCCGGCACTGGGAGCTGCATCTGAGGCTTAGTCCCTGAG<br>CTCTCTGCCTGCCCAGACTAGCTGCACCTCCTCATTCCCTGCGCCCCCTTCCTCTCCGG<br>AAGCCCCCAGGATGGTGAGGTAAGGGCCTGCCACCCACGGTAGACAGGAGGCAAG<br>GGTGCCTGGTGCCCACGGGACCCCTCCTCACTGCCCTGCCTGGGCCGCCCAGGtgacg<br>actgtgccttctagttgccagccatctgttgtttgcccctcccccgtgccttccttgaccctggaaggtgccactcc<br>cactgtcctttcctaataaaatgaggaaattgcatcgcattgtctgagtaggtgtcattctattctgggggtggg<br>gtggggcaggacagcaaggggaggattgggaagacaatagcaggcatgctggggatgcggtgggctctat<br>ggGGATCTGCGATCGCTCCGGTGCCCGTCAGTGGGCAGAGCGCACATCGCCCACAG<br>TCCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcatttttttcactgcattctag<br>ttgtggttttgtccaaactcatcaatgtatcttatTGGTTTCACCGAGACCTCAGTGGGCTGGATGC<br>AGAGACCCTGCTCAAGGGCCGAGGTGTCCACGGTAGCTTCCTGGCTCGGCCCAGTC<br>GCAAGAACCAGGGTGACTTCTCGCTCTCCGTCAGGTAGGTGGGCCCCCCGCAACCC<br>CGGGCATTTTGGCCACTCTCTTGTGCCATCCAGGCCCTGAACCACTCATTCCTGGTTC<br>CCCGTGGCAGTGCTGACTCCCCGTCGTTCCCTTGCCCCCAACCCCCACACTCCCCAT | 2541 |

TABLE 5-continued

CONSTRUCTS USED FOR EVALUATION OF PREDICTED LOCI

| Construct name | Sequence | Length |
|---|---|---|
| | CCCTGTCTGTGCCCACCCATGCCCATGTGTGCCCCACCCAGGACCTCAGCCGATCCC<br>TGCCCTCCTGCCTCTACTCCTGCACCGACTGGCCTCACCGCCTGGTGCCCTGCAGGGT<br>GGGGGATCAGGTGACCCATATTCGGATCCAGAACTCAGGGGATTTCTATGACCTGT<br>ATGGAGGGGAGAAGTTTG (SEQ ID NO: 267) | 2541 |
| pARB1-663:<br>PTPRC_LE<br>xogenous_4<br>0 | TCTTTAGCTAATGTTCTGTAGCTTGTTTTAGATCTGTGTCTACATATTATATGTATCTC<br>TGTATGCATCAATATTTGTATATATGCATGCATATATGTGTATGTATATTTATGAATA<br>CATATACACACCATATACATACACTTATGTATGGTGTGTGCATATGTATGTGTAGATA<br>TATGTACATACACACTATAGTGGACTGGGGAGTTAGTATACTGGGAGGAGCATACA<br>TTTAGGGTATGATTCACATATTTATTTTGTCCTTCTCCCATTTTCCATTAATTAACAGG<br>ATTGACTACAGCAAAGATGCCCAGTGTTCCACTTTCAAGTGACCCCTTACCTACTCAC<br>ACCACTGCATTCTCACCCGCAAGCACCTTTGAAAGAGAAAATGACTTCTCAGAGACC<br>ACAACTTCTCTTAGTCCAGACAATACTTCCACCCAAGTATCCCCGtgacgactgtgccttcta<br>gttgccagccatctgttgtttgccctccccgtgcttcttgaccctggaaggtgccactcccactgtcctttcc<br>taataaaatgaggaaattgcatcgcattgtctgagtaggtgtcattctattctgggggtggggtggggcagga<br>cagcaaggggggaggattgggaagacaatagcaggcatgctgggatgcggtgggctctatggGGATCTG<br>CGATCGCTCCGGTGCCCGTCAGTGGGCAGAGCGCACATCGCCCACAGTCCCCGAGA<br>AGTTGGGGGAGGGTCGGCAATTGAACGGGTGCCTAGAGAAGGTGGCGCGGGG<br>TAAACTGGGAAAGTGATGTCGTGTACTGGCTCCGCCTTTTTCCCGAGGGTGGGGGA<br>GAACCGTATATAAGTGCAGTAGTCGCCGTGAACGTTCTTTTTCGCAACGGGTTTGCC<br>GCCAGAACACAGCTGAAGCTTCGAGGGGCTCGCATCTCTCCTTCACGCGCCCGCCG<br>CCTACCTGAGGCCGCCATCCACGCCGGTTGAGTCGCGTTCTGCCGCCTCCCGCCTGT<br>GGTGCCTCCTGAACTGCGTCCGCCGTCTAGGTAAGTTTAAAGCTCAGGTCGAGACCG<br>GGCCTTTGTCCGGCGCTCCCTTGGAGCCTACCTAGACTCAGCCGGCTCTCCACGCTT<br>GCCTGACCCTGCTTGCTCAACTCTACGTCTTTGTTTCGTTTTCTGTTCTGCGCCGTTAC<br>AGATCCAAGCTGTGACCGGCGCCTACTCTAGAGCTAGCGAATTgccgccaccATGGTG<br>AGCAAGGGCGAGGAGCTGTTCACCGGGGTGGTGCCCATCCTGGTCGAGCTGGACG<br>GCGACGTAAACGGCCACAAGTTCAGCGTGTCCGGCGAGGGCGAGGGCGATGCCAC<br>CTACGGCAAGCTGACCCTGAAGTTCATCTGCACCACCGGCAAGCTGCCCGTGCCCTG<br>GCCCACCCTCGTGACCACCCTGACCTACGGCGTGCAGTGCTTCAGCCGCTACCCCGA<br>CCACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAtgattgtttattgcagcttataatgg<br>ttacaaataaagcaatagcatcacaaatttcacaaataaagcatttttttcactgcattctagttgtggtttgtcc<br>aaactcatcaatgtatcttatGACTCTTTGGATAATGCTAGTGCTTTTAATACCACAGGTTGG<br>CACACAAAAGTTGTTAACTTAAATATCAGGGAATGTCATTTAGAAAATTCTACAGTTA<br>TCAGTACAACTTGTCTTTAAATTATTTGCACAGTTTCTAAGTATGTGATTTTATTCAAG<br>TGCAGAAATTGCAGGAAATTAGTATCTGTGAAATATAGATCGACTGAAGTAATTAAT<br>GCATGTTGTTAGGGAGTGGAGAGAGAAAAGAAGGGAAGCAAGTATTCCAAGGACA<br>ATCAGGAGGGGAAATTTGTTCTAGTATCCTCTGATCTATACACACTCGCCATGATTCT<br>CCCGCTTGGCTTCCCGCCACCTGGACAGATGAGAATTTCCCTAGTTCAGAGATTATC<br>AGTTCTACTCCCTTGGAAGGTGTCTTAAATGGGAGTCTTCCCATTTCTTTGTTTCACT<br>CTAGA (SEQ ID NO: 268) | 2541 |
| pARB1-664:<br>PTPRC_2_E<br>xogenous_4<br>1 | AGGGAATTTTTATATGTTGGTCATATTATATCCCTAGCATGTGGCATAATGTCTAGCA<br>CAAAATAGGTGCTCAATTAATCATCATTATCTAAATAAATAATGCATTTGGGAAAAA<br>AAAGTTTCAAAAGTTTTTCAAAAGTCTTTTGCAGGCTTGAAATTAATCCCAATAGTGA<br>TCCTTTAGTCTGTTATGTTTCTGATTTAGCCTGGGGATTCAAAAAATAAATAACATAA<br>TTTTGATATATTTGGGCTTTGTAAACATGGTACTAAGAGAGGAAATATAGTTTCATTA<br>GGGTAAAAGCTACTGAAAATTGCCACTTGGTGAATGTTCTATCATAGACTTGAGGTA<br>CATATAAAAATCTAATATATGTTTACATTAATATGAATGAAATTTGAAATTTTCTAAG<br>AGATTTTGTTTCTTCTTTGCAGGGCAAAGCCCAACACCTTCCCCCtgacgactgtgccttct<br>agttgccagccatctgttgtttgccctccccgtgcttcttgaccctggaaggtgccactcccactgtcctttc<br>ctaataaaatgaggaaattgcatcgcattgtctgagtaggtgtcattctattctgggggtggggtggggcagg<br>acagcaaggggaggattgggaagacaatagcaggcatgctgggatgcggtgggctctatggGGATCT<br>GCGATCGCTCCGGTGCCCGTCAGTGGGCAGAGCGCACATCGCCCACAGTCCCCGAG<br>AAGTTGGGGGAGGGTCGGCAATTGAACGGGTGCCTAGAGAAGGTGGCGCGGG<br>GTAAACTGGGAAAGTGATGTCGTGTACTGGCTCCGCCTTTTTCCCGAGGGTGGGGG<br>AGAACCGTATATAAGTGCAGTAGTCGCCGTGAACGTTCTTTTTCGCAACGGGTTTGC<br>CGCCAGAACACAGCTGAAGCTTCGAGGGGCTCGCATCTCTCCTTCACGCGCCCGCCG<br>CCCTACCTGAGGCCGCCATCCACGCCGGTTGAGTCGCGTTCTGCCGCCTCCCGCCTG<br>TGGTGCCTCCTGAACTGCGTCCGCCGTCTAGGTAAGTTTAAAGCTCAGGTCGAGACC<br>GGGCCTTTGTCCGGCGCTCCCTTGGAGCCTACCTAGACTCAGCCGGCTCTCCACGCT<br>TGCCTGACCCTGCTTGCTCAACTCTACGTCTTTGTTTCGTTTTCTGTTCTGCGCCGTT<br>ACAGATCCAAGCTGTGACCGGCGCCTACTCTAGAGCTAGCGAATTgccgccaccATGGT<br>GAGCAAGGGCGAGGAGCTGTTCACCGGGGTGGTGCCCATCCTGGTCGAGCTGGAC<br>GGCGACGTAAACGGCCACAAGTTCAGCGTGTCCGGCGAGGGCGAGGGCGATGCCA<br>CCTACGGCAAGCTGACCCTGAAGTTCATCTGCACCACCGGCAAGCTGCCCGTGCCCT<br>GGCCCACCCTCGTGACCACCCTGACCTACGGCGTGCAGTGCTTCAGCCGCTACCCCG | 2541 |

TABLE 5-continued

CONSTRUCTS USED FOR EVALUATION OF PREDICTED LOCI

| Construct name | Sequence | Length |
|---|---|---|
| | ACCACATGAAGCAGCACGACTTCTTCAAGTCCGCCATGCCCGAAGGCTACGTCCAGG<br>AGCGCACCATCTTCTTCAAGGACGACGGCAACTACAAGACCCGCGCCGAGGTGAAG<br>TTCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAtgattgtttattgcagcttataatgg<br>ttacaaataaagcaatagcatcacaaatttcacaaataaagcattttttcactgcattctagttgtggtttgtcc<br>aaactcatcaatgtatcttatACTGGTAAGAATTAATATTTATATTTTTACTAATTTTATTTTCT<br>TGTTGCAAAGTTTATATATTTAACTACAATTTTCTATTATTAACACTGAAATTATTTTT<br>AAGGATAAATTTTATAATCATGAGTGATTCTTGACATTCACTTGTTCTTAAACTTTCTG<br>CTTATACGTTATAGAGTTTAATAACTACCTAAACATGTTATTAAATTTGTATATATATT<br>TTGTGTATAAATAGTAACTTTTCCCAAACTTGACAGTAAATCACACAACAGGTTTCTA<br>CTCTCTTTTAATATTTTAAGACTATAAAAAAATGCATTTAAATTAGATAACAAATTTT<br>ATAGTCTGAAAGCAGGTTAACAGCTGTCTATGTATGTTATAGATATGTAGATAACAG<br>ATTTGCATATGTCTATATTTCTTTAAGAGTATGTTGCTTTTTTCAATGGTATGCA (SEQ ID NO: 269) | |
| pARBI-665:<br>PTPRC_3_E<br>xogenous_4<br>2 | CCTTTAGCACCATAAAGAAACTAAATTATTTAGATGTTMATGAGAACATATCAAAA<br>AGTACTTTTCTGTCATCCAATACTTCCACAAATAAATCATTAGTTCTTGCTAATCTTCA<br>TCTGGCATAAAAATAATGACATCAACTTTCTTCATGTAATTTCCCACTTAATTCCTTTA<br>CTAGGAGCAATATCAATTCCTATATGACGTCATTGCCAGCACCTACCCTGCTCAGAAT<br>GGACAAGTAAAGAAAAACAACCATCAAGAAGATAAAATTGAATTTGATAATGAAGT<br>GGACAAAGTAAAGCAGGATGCTAATTGTGTTAATCCACTTGGTGCCCCAGAAAAGC<br>TCCCTGAAGCAAAGGAACAGGCTGAAGGTTCTGAACCCACGAGTGGCACTGAGGG<br>GCCAGAACATTCTGTCAATGGTCCTGCAAGTCCAGCTTTAAATCAAGGTtgacgactgtg<br>ccttctagttgccagccatctgttgtttgcccctccccgtgccttccttgaccctggaaggtgccactcccactgt<br>cctttcctaataaaatgaggaaattgcatcgcattgtctgagtaggtgtcattctattctgggggtggggtggg<br>gcaggacagcaaggggggaggattgggaagacaatagcaggcatgctggggatgcggtgggctctatggGG<br>ATCTGCGATCGCTCCGGTGCCCGTCAGTGGGCAGAGCGCACATCGCCCACAGTCCCC<br>GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAAtgattgtttattgcagcttat<br>aatggttacaaataaagcaatagcatcacaaatttcacaaataaagcattttttcactgcattctagttgtggtt<br>tgtccaaactcatcaatgtatcttatTCATAGGAAAAGACATAAATGAGGAAACTCCAAACCT<br>CCTGTTAGCTGTTATTTCTATTTTTGTAGAAGTAGGAAGTGAAAATAGGTATACAGT<br>GGATTAATTAAATGCAGCGAACCAATATTTGTAGAAGGGTTATATTTTACTACTGTG<br>GAAAAATATTTAAGATAGTTTTGCCAGAACAGTTTGTACAGACGTATGCTTATTTTAA<br>AATTTTATCTCTTATTCAGTAAAAAACAACTTCTTTGTAATCGTTATGTGTATATGT<br>ATGTGTGTATGGGTGTGTTTGTGAGAGACAGAGAAAGAGAGAGAATTCTTTC<br>AAGTGAATCTAAAAGCTTTTGCTTTTCCTTTGTTTTTATGAAGAAAAAATACATTTTAT<br>ATTAGAAGTGTTAACTTAGCTTGAAGGATCTGTTTTTAAAAATCATAAACTGTGTGCA<br>GACTCAATA (SEQ ID NO: 270) | 2541 |
| pARBI-666:<br>PTPRCAP_1<br>_Exogenous<br>_43 | aaggaaaaaggcactgagtgctgggggtgctgggtgggctgcagtgatagacatcagggtagaggttaag<br>gtcaggttcagcctcactggggtgaagtttgagcacggtgagcaggccatgcagcccgggggagggaggat<br>gggaggaggtggagctttccgggcagagggaacagccagtgcgaaggccccaggcaggtggcttaatgcag<br>ctgttgggggaggtgagtggtagggaggaggctggagggatgggggctgatctcacagggccagagcctggt<br>tgaccaaataaggccttggcctttttctGCTTGGCTGTCCCAAGAGGATCCCAAAGAGAAAAA<br>ACGAAAGTGGTCTTGGTCACCCAGCCTGCCCCACACCAGGCCCCACCCCAG<br>AGCCCTCTGAGCCCCTGCCTGTCTCCCACAGGCTCTGCCCTGCtgacgactgtgccttctagtGTGCTG<br>tgccagccatctgttgtttgcccctccccgtgccttccttgaccctggaaggtgccactcccactgtccttcctaat<br>aataaaatgaggaaattgcatcgcattgtctgagtaggtgtcattctattctgggggtggggtggggcaggaca<br>gcaaggggggaggattgggaagacaatagcaggcatgctggggatgcggtgggctctatggGGATCTGCG | 2541 |

TABLE 5-continued

CONSTRUCTS USED FOR EVALUATION OF PREDICTED LOCI

| Construct name | Sequence | Length |
|---|---|---|
| | ATCGCTCCGGTGCCCGTCAGTGGGCAGAGCGCACATCGCCCACAGTCCCCGAGAAG<br>TTGGGGGGAGGGGTCGGCAATTGAACGGGTGCCTAGAGAAGGTGGCGCGGGGTA<br>AACTGGGAAAGTGATGTCGTGTACTGGCTCCGCCTTMCCCGAGGGTGGGGGAGA<br>ACCGTATATAAGTGCAGTAGTCGCCGTGAACGTTCTTTTTCGCAACGGGTTTGCCGC<br>CAGAACACAGCTGAAGCTTCGAGGGGCTCGCATCTCTCCTTCACGCGCCCGCCGCCC<br>TACCTGAGGCCGCCATCCACGCCGGTTGAGTCGCGTTCTGCCGCCTCCCGCCTGTGG<br>TGCCTCCTGAACTGCGTCCGCCGTCTAGGTAAGTTTAAAGCTCAGGTCGAGACCGGG<br>CCTTTGTCCGGCGCTCCCTTGGAGCCTACCTAGACTCAGCCGGCTCTCCACGCTTTGC<br>CTGACCCTGCTTGCTCAACTCTACGTCTTTGMCGTTTTCTGTTCTGCGCCGTTACAG<br>ATCCAAGCTGTGACCGGCGCCTACTCTAGAGCTAGCGAATTgccgccaccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatACCTTAGGGCTCGGGATGCTGCTGGCCCTGCCAGGGGCCTT<br>GGGCTCGGGTGGCAGCGCGGAGGACAGCGTGGGCTCCAGCTCTGTCACCGTTGTCc<br>tgctgctgctgctgctcctactgctgGCCACTGGCCTAGCACTGGCCTGGCGCCGCCTCAGCC<br>GTGACTCAGGGGGCTACTACCACCCGGCCCGCCTAGGTGCCGCGCTGTGGGGCCGC<br>ACGCGGCGCCTGCTCTGGGCCAGCCCCCAGGTCGCTGGCTGCAGGCCCGAGCTGA<br>GCTGGGGTCCACAGACAATGACCTTGAGCGACAGGAGGATGAGCAGGACACAGAC<br>TATGACCACGTCGCGGATGGTGGCCTGCAGGCTGACCCTGGGGAAGGCGAGCAGC<br>AATGTGGAGAGGCGTCCAGCCCAGAGCAGGTCCCCGTGCGGGCTGAGGAAGCCAG<br>AGACAGTGACACG (SEQ ID NO: 271) | |
| pARBI-667:<br>PTPRCAP_2<br>_Exogenous<br>_44 | aaggtcaggttcagcctcactggggtgaagtttgagcacggtgagcaggccatgcagcccggggaggggag<br>gatgggagggaggtggagctttccgggcagagggaacagccagtgcgaaggcccaggcaggtggcttaatgc<br>agctgttggggggaggtgagtggtaggggaggagctggagggatgggggctgatctcacagggccagagcctg<br>gttgaccaaataaggcctggccttttctGCTTGGCTGTCCCAAGAGGATCCCAAAGAGAAAA<br>AACGAAAGTGGTCTTGGTCACCCAGCCTGCCCCACACCAGGCCCCACCCCAGGTGCT<br>GAGCCCTCTGAGCCCCTGCCTGTCTCCCACAGGCTCTGCCCTGCACCTTAGGGCTCG<br>GGATGCTGCTGGCCCTGCCAGGGGCCTTGGGCTCGGGTGGCAGCGCGGAGGACAG<br>Ctgacgactgtgccttctagttgccagccatctgttgtttgccctccccgtgccttccttgacctggaaggtgc<br>cactcccactgtcctttcctaataaaatgaggaaattgcatcgcattgtctgagtaggtgtcattctattctgggg<br>ggtggggtggggcaggacagcaaggggggaggattgggaagacaatagcaggcatgctggggatgcggtggg<br>ctctatggGGATCTGCGATCGCTCCGGTGCCCGTCAGTGGGCAGAGCGCACATCGCCC<br>ACAGTCCCCGAGAAGTTGGGGGGAGGGGTCGGCAATTGAACGGGTGCCTAGAGAA<br>GGTGGCGCGGGGTAAACTGGGAAAGTGATGTCGTGTACTGGCTCCGCCTTTTTCCC<br>GAGGGTGGGGGAGAACCGTATATAAGTGCAGTAGTCGCCGTGAACGTTCTTTTTCG<br>CAACGGGTTTGCCGCCAGAACACAGCTGAAGCTTCGAGGGGCTCGCATCTCTCCTTC<br>ACGCGCCCGCCGCCCTACCTGAGGCCGCCATCCACGCCGGTTGAGTCGCGTTCTGCC<br>GCCTCCCGCCTGTGGTGCCTCCTGAACTGCGTCCGCCGTCTAGGTAAGTTTAAAGCT<br>CAGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcattttttcactgc<br>attctagttgtggtttgtccaaactcatcaatgtatcttatGTGGGCTCCAGCTCTGTCACCGTTGTCc<br>tgctgctgctgctgctcctactgctgGCCACTGGCCTAGCACTGGCCTGGCGCCGCCTCAGCC<br>GTGACTCAGGGGGCTACTACCACCCGGCCCGCCTAGGTGCCGCGCTGTGGGGCCGC<br>ACGCGGCGCCTGCTCTGGGCCAGCCCCCAGGTCGCTGGCTGCAGGCCCGAGCTGA<br>GCTGGGGTCCACAGACAATGACCTTGAGCGACAGGAGGATGAGCAGGACACAGAC<br>TATGACCACGTCGCGGATGGTGGCCTGCAGGCTGACCCTGGGGAAGGCGAGCAGC<br>AATGTGGAGAGGCGTCCAGCCCAGAGCAGGTCCCCGTGCGGGCTGAGGAAGCCAG | 2541 |

TABLE 5-continued

CONSTRUCTS USED FOR EVALUATION OF PREDICTED LOCI

| Construct name | Sequence | Length |
|---|---|---|
| | AGACAGTGACACGGAGGGCGACCTGGTCCTCGGCTCCCCAGGACCAGCGAGCGCA<br>GGGGGCAGTGCTGAGGCCCTGCTGAGT (SEQ ID NO: 272) | |
| pARBI-668:<br>PTPRCAP_3<br>Exogenous<br>45 | cagtgcgaaggcccccaggcaggtggcttaatgcagctgttgggggaggtgagtggtagggaggaggctggag<br>ggatgggggctgatctcacagggccagagcctggttgaccaaataaggccttggccttttctGCTTGGCTG<br>TCCCAAGAGGATCCCAAAGAGAAAAAAACGAAAGTGGTCTTGGTCACCCAGCCTGC<br>CCCACACCAGGCCCCACCCCAGGTGCTGAGCCCTCTGAGCCCCTGCCTGTCTCCCAC<br>AGGCTCTGCCCTGCACCTTAGGGCTCGGGATGCTGCTGGCCCTGCCAGGGGCCTTG<br>GGCTCGGGTGGCAGCGCGGAGGACAGCGTGGGCTCCAGCTCTGTCACCGTTGTCct<br>gctgctgctgctgctcctactgctgGCCACTGCCTAGCACTGGCCTGGCGCCGCCTCAGCCG<br>TGACTCAGGGGGCTACTACTgacgactgtgccttctagttgccagccatctgttgtttgccctcccccg<br>tgccttccttgaccctggaaggtgccactcccactgtcctttcctaataaaaatgaggaaattgcatcgcattgtct<br>gagtaggtgtcattctattctgggggtggggtggggcaggacagcaaggggggaggattgggaagacaatag<br>caggcatgctggggatgcggtgggctctatggGGATCTGCGATCGCTCCGGTGCCCGTCAGTGG<br>GCAGAGCGCACATCGCCCACAGTCCCCGAGAAGTTGGGGGGAGGGGTCGGCAATT<br>GAACGGGTGCCTAGAGAAGGTGGCGCGGGGTAAACTGGGAAAGTGATGTCGTGTA<br>CTGGCTCCGCCTTTTTCCCGAGGGTGGGGGAGAACCGTATATAAGTGCAGTAGTCG<br>CCGTGAACGTTCTTTTTCGCAACGGGTTTGCCGCCAGAACACAGCTGAAGCTTCGAG<br>GGGCTCGCATCTCTCCTTCACGCGCCCGCCGCCCTACCTGAGGCCGCCATCCACGCC<br>GGTTGAGTCGCGTTCTGCCGCCTCCCGCCTGTGGTGCCTCCTGAACTGCGTCCGCCG<br>TCTAGGTAAGTTTAAAGCTCAGGTCGAGACCGGGCCTTTGTCCGGCGCTCCCTTGGA<br>GCCTACCTAGACTCAGCCGGCTCTCCACGCTTTGCCTGACCCTGCTTGCTCAACTCTA<br>CGTCTTTGTTTCGTTTTCTGTTCTGCGCCGTTACAGATCCAAGCTGTGACCGGCGCCT<br>ACTCTAGAGCTAGCGAATTgccgccaccATGGTGAGCAAGGGCGAGGAGCTGTTCACC<br>GGGGTGGTGCCCATCCTGGTCGAGCTGGACGGCGACGTAAACGGCCACAAGTTCA<br>GCGTGTCCGGCGAGGGCGAGGGCGATGCCACCTACGGCAAGCTGACCCTGAAGTT<br>CATCTGCACCACCGGCAAGCTGCCCGTGCCCTGGCCCACCCTCGTGACCACCCTGAC<br>CTACGGCGTGCAGTGCTTCAGCCGCTACCCCGACCACATGAAGCAGCACGACTTCTT<br>CAAGTCCGCCATGCCCGAAGGCTACGTCCAGGAGCGCACCATCTTCTTCAAGGACG<br>ACGGCAACTACAAGACCCGCGCCGAGGTGAAGTTCGAGGGCGACACCCTGGTGAA<br>CCGCATCGAGCTGAAGGGCATCGACTTCAAGGAGGACGGCAACATCCTGGGGCAC<br>AAGCTGGAGTACAACTACAACAGCCACAACGTCTATATCATGGCCGACAAGCAGAA<br>GAACGGCATCAAGGTGAACTTCAAGATCCGCCACAACATCGAGGACGGCAGCGTGC<br>AGCTCGCCGACCACTACCAGCAGAACACCCCCATCGGCGACGGCCCCGTGCTGCTG<br>CCCGACAACCACTACCTGAGCACCCAGTCCAAGCTGAGCAAAGACCCCAACGAGAA<br>GCGCGATCACATGGTCCTGCTGGAGTTCGTGACCGCCGCCGGGATCACTCTCGGCAT<br>GGACGAGCTGTACAAAatgattgtttattgcagcttataatggttacaaataaagcaatagcatcacaaat<br>ttcacaaataaagcattttttttcactgcattctagttgtggtttgtccaaactcatcaatgtatcttatCACCCG<br>GCCCGCCTAGGTGCCGCGCTGTGGGGCCGCACGCGGCGCCTGCTCTGGGCCAGCCC<br>CCCAGGTCGCTGGCTGCAGGCCCGAGCTGAGCTGGGGTCCACAGACAATGACCTTG<br>AGCGACAGGAGGATGAGCAGGACACAGACTATGACACGTCGCGGATGGTGGCCT<br>GCAGGCTGACCCTGGGGAAGGCGAGCAGCAATGTGGAGAGGCGTCCAGCCCAGAG<br>CAGGTCCCCGTGCGGGCTGAGGAAGCCAGAGACAGTGACACGGAGGGCGACCTGG<br>TCCTCGGCTCCCCAGGACCAGCGAGCGCAGGGGGCAGTGCTGAGGCCCTGCTGAGT<br>GACCTGCACGCCTTTGCTGGCAGCGCAGCCTGGGATGACAGCGCCAGGGCAGCTGG<br>GGGCCAGGGCCTCCATGTCACCGCACTGTAGAGGCCGGTCTTGGTGTCCCATCCC<br>(SEQ ID NO: 273) | 2541 |
| pARBI-669:<br>RP523_1_E<br>xogenous_4<br>6 | ATAGAGTAGGGCGGGGGATGCCATGGAGAGGCTCCATGGGGGAGGGCCGGGGAA<br>GCGCCGCTCCAGGAGGCACGTGGTCCGGCGCGAAGGGGCCCATGAGGCGTGGA<br>GGCCGCCGAGGTCGGGGTACCGAGGGACGCAGGGAGGCCAGCGCTTCCTCCCGGG<br>CATTCGAGCGGGGCCTCGTCCTTCGGGAGAACACATTCTCCGGAGCCCTCTTCGAAC<br>GTTTATTAGTCGGTTCAGGGCAACTTGAAGGCCAAATGTTTGGCCCACAGGCCAATA<br>AATAGTACGAGAGCCAATCGGCTTAAGGGTTTATTCCAGGTGAGGCGAGTGTCTTA<br>GAAGATGGGAAACACGTAGATGGCGTGTTTTTACGGAAGAACTAAAATATTTAATTT<br>TTAGGCAAGTGTCGTGGACTTCGTACTGCTAGGAAGCTCCGTAGTCACCGACGAGA<br>CCAGtgacgactgtgccttctagttgccagccatctgttgtttgccctcccccgtgccttccttgaccctggaa<br>ggtgccactcccactgtcctttcctaataaaaatgaggaaattgcattgtctgagtaggtgtcattctattc<br>tgggggtggggtggggcaggacagcaaggggggaggattgggaagacaatagcaggcatgctggggatgcg<br>gtgggctctatggGGATCTGCGATCGCTCCGGTGCCCGTCAGTGGGCAGAGCGCACATC<br>GCCCACAGTCCCCGAGAAGTTGGGGGGAGGGGTCGGCAATTGAACGGGTGCCTAG<br>AGAAGGTGGCGCGGGGTAAACTGGGAAAGTGATGTCGTGTACTGGCTCCGCCTTTT<br>TCCCGAGGGTGGGGGAGAACCGTATATAAGTGCAGTAGTCGCCGTGAACGTTCTTT<br>TTCGCAACGGGTTTGCCGCCAGAACACAGCTGAAGCTTCGAGGGGCTCGCATCTCTC<br>CTTCACGCGCCCGCCGCCCTACCTGAGGCCGCCATCCACGCCGGTTGAGTCGCGTTC<br>TGCCGCCTCCCGCCTGTGGTGCCTCCTGAACTGCGTCCGCCGTCTAGGTAAGTTTAA<br>AGCTCAGGTCGAGACCGGGCCTTTGTCCGGCGCTCCCTTGGAGCCTACCTAGACTCA<br>GCCGGCTCTCCACGCTTTGCCTGACCCTGCTTGCTCAACTCTACGTCTTTGTTTCGTTT<br>TCTGTTCTGCGCCGTTACAGATCCAAGCTGTGACCGGCGCCTACTCTAGAGCTAGCG<br>AATTgccgccaccATGGTGAGCAAGGGCGAGGAGCTGTTCACCGGGGTGGTGCCCATC<br>CTGGTCGAGCTGGACGGCGACGTAAACGGCCACAAGTTCAGCGTGTCCGGCGAGG<br>GCGAGGGCGATGCCACCTACGGCAAGCTGACCCTGAAGTTCATCTGCACCACCGGC<br>AAGCTGCCCGTGCCCTGGCCCACCCTCGTGACCACCCTGACCTACGGCGTGCAGTGC<br>TTCAGCCGCTACCCCGACCACATGAAGCAGCACGACTTCTTCAAGTCCGCCATGCCC<br>GAAGGCTACGTCCAGGAGCGCACCATCTTCTTCAAGGACGACGGCAACTACAAGAC | 2541 |

TABLE 5-continued

CONSTRUCTS USED FOR EVALUATION OF PREDICTED LOCI

| Construct name | Sequence | Length |
|---|---|---|
| | CCGCGCCGAGGTGAAGTTCGAGGGCGACACCCTGGTGAACCGCATCGAGCTGAAG<br>GGCATCGACTTCAAGGAGGACGGCAACATCCTGGGGCACAAGCTGGAGTACAACTA<br>CAACAGCCACAACGTCTATATCATGGCCGACAAGCAGAAGAACGGCATCAAGGTGA<br>ACTTCAAGATCCGCCACAACATCGAGGACGGCAGCGTGCAGCTCGCCGACCACTAC<br>CAGCAGAACACCCCCATCGGCGACGGCCCCGTGCTGCTGCCCGACAACCACTACCTG<br>AGCACCCAGTCCAAGCTGAGCAAAGACCCCAACGAGAAGCGCGATCACATGGTCCT<br>GCTGGAGTTCGTGACCGCCGCCGGGATCACTCTCGGCATGGACGAGCTGTACAAatg<br>attgtttattgcagcttataatggttacaaataaagcaatagcatcacaaatttcacaaataaagcatttttttca<br>ctgcattctagttgtggtttgtccaaactcatcaatgtatcttatAAGTGGCATGATAAACAGTATAAG<br>AAAGCTCATTTGGGCACAGCCCTAAAGGCCAACCCTTTTGGAGGTGCTTCTCATGCA<br>AAAGGAATCGTGCTGGAAAAAGTGTAAGTCCATTGCTCCCGTCAAGTTTTAGTTTAT<br>TATAGGAATTCGAGACATGAACTTACGAATTCTTGTTTTGAAAGTAATTGCAGGTM<br>TGTGTAGTAGTATTCATTTGGGCATTGTGGGTAAAATTGCAAAGCGTTTGTTCTAT<br>TTAAAAGTTGGTAAAATTAGTTTTTGGGAATTAGGTAGTTAAGGTTTTAATTTAACGT<br>TGGCCTGGAAGGAATTGGAGAAGATACTAGCAATGATGAAGTAAAGGACACAAAC<br>ACCTTTACTGTGGGAGTTGTTATAAGTAAATGGCACGTGTCAGCTATTGAACTTTATC<br>GACTTGATAAAACTAAGGTGAAGAGA (SEQ ID NO: 274) | |
| pARBI-670:<br>RPS23_2_E<br>xogenous_4<br>7_48 | CAAGCGGGACTTGGGGTCTTGGGGACGGGCGGGCGGATGCGAATAGAGTAGGGC<br>GGGGGATGCCATGGAGAGGCTCCATGGGGAGGGCCGGGGAAGCGCCGCTCCAG<br>GAGGCACGTGGTCCGGCGCGGAAGGGGCCCATGAGGCGTGGAGGCCGCCGAGGT<br>CGGGGTACCGAGGGACGCAGGGAGGCCAGCGCTTCCTCCCGGGCATTCGAGCGGG<br>GCCTCGTCCTTCGGGAGAACACATTCTCCGGAGCCCTCTTCGAACGTTTATTAGTCG<br>GTTCAGGGCAACTTGAAGGCCAAATGTTTGGCCCACAGGCCAATAAATAGTACGAG<br>AGCCAATCGGCTTAAGGGTTTATTCCAGGTGAGGCGAGTGTCTTAGAAGATGGGAA<br>ACACGTAGATGGCGTGTTTTTACGGAAGAACTAAAATATTTAATTTTTAGGCAAGTG<br>CCGCGGAtgacgactgtgccttctagttgccagccatctgttgtttgcccctcccccgtgccttccttgaccctg<br>gaaggtgccactcccactgtcctttcctaataaaatgaggaaattgcatcgcattgtctgagtaggtgtcattct<br>attctgggggtggggtggggcaggacagcaaggggggaggattgggaagacaatagcaggcatgctgggga<br>tgcggtgggctctatggGGATCTGCGATCGCTCCGGTGCCCGTCAGTGGGCAGAGCGCAC<br>ATCGCCCACAGTCCCCGAGAAGTTGGGGGGAGGGGTCGGCAATTGAACGGGTGCC<br>TAGAGAAGGTGGCGCGGGGTAAACTGGGAAAGTGATGTCGTGTACTGGCTCCGCC<br>TTTTTCCCGAGGGTGGGGGAGAACCGTATATAAGTGCAGTAGTCGCCGTGAACGTT<br>CTTTTTCGCAACGGGTTTGCCGCCAGAACACAGCTGAAGCTTCGAGGGGCTCGCATC<br>TCTCCTTCACGCGCCCGCCGCCCTACCTGAGGCCGCCATCCACGCCGGTTGAGTCGC<br>GTTCTGCCGCCTCCCGCCTGTGGTGCCTCCTGAACTGCGTCCGCCGTCTAGGTAAGT<br>TTAAAGCTCAGGTCGAGACCGGGCCTTTGTCCGGCGCTCCCTTGGAGCCTACCTAGA<br>CTCAGCCGGCTCTCCACGCTTTGCCTGACCCTGCTTGCTCAACTCTACGTCTTTGTTTC<br>GTTTTTCTGTTCTGCGCCGTTACAGATCCAAGCTGTGACCGGCGCCTACTCTAGAGCTA<br>GCGAATTgccgccaccATGGTGAGCAAGGGCGAGGAGCTGTTCACCGGGGTGGTGCC<br>CATCCTGGTCGAGCTGGACGGCGACGTAAACGGCCACAAGTTCAGCGTGTCCGGCG<br>AGGGCGAGGGCGATGCCACCTACGGCAAGCTGACCCTGAAGTTCATCTGCACCACC<br>GGCAAGCTGCCCGTGCCCTGGCCCACCCTCGTGACCACCCTGACCTACGGCGTGCAG<br>TGCTTCAGCCGCTACCCCGACCACATGAAGCAGCACGACTTCTTCAAGTCCGCCATG<br>CCCGAAGGCTACGTCCAGGAGCGCACCATCTTCTTCAAGGACGACGGCAACTACAA<br>GACCCGCGCCGAGGTGAAGTTCGAGGGCGACACCCTGGTGAACCGCATCGAGCTG<br>AAGGGCATCGACTTCAAGGAGGACGGCAACATCCTGGGGCACAAGCTGGAGTACA<br>ACTACAACAGCCACAACGTCTATATCATGGCCGACAAGCAGAAGAACGGCATCAAG<br>GTGAACTTCAAGATCCGCCACAACATCGAGGACGGCAGCGTGCAGCTCGCCGACCA<br>CTACCAGCAGAACACCCCCATCGGCGACGCCCCCGTGCTGCTGCCCGACAACCACTA<br>CCTGAGCACCCAGTCCAAGCTGAGCAAAGACCCCAACGAGAAGCGCGATCACATGG<br>TCCTGCTGGAGTTCGTGACCGCCGCCGGGATCACTCTCGGCATGGACGAGCTGTAC<br>AAatgattgtttattgcagcttataatggttacaaataaagcaatagcatcacaaatttcacaaataaagcatt<br>tttttcactgcattctagttgtggtttgtccaaactcatcaatgtatcttatCTTCGTACTGCTAGGAAGCT<br>CCGTAGTCACCGACGAGACCAGAAGTGGCATGATAAACAGTATAAGAAAGCTCATT<br>TGGGCACAGCCCTAAAGGCCAACCCTTTTGGAGGTGCTTCTCATGCAAAAGGAATC<br>GTGCTGGAAAAAGTGTAAGTCCATTGCTCCCGTCAAGTTTTAGTTTATTATAGGAATT<br>CGAGACATGAACTTACGAATTCTTGTTTTGAAAGTAATTGCAGGTTTTTGTGTAGTA<br>GTATTCATTTGGGCATTGTGGGTAAAATTGCAAAGCGTTTGTTCTATTTAAAAGTT<br>GGTAAAATTAGTTTTTGGGAATTAGGTAGTTAAGGTTTTAATTTAACGTTGGCCTGG<br>AAGGAATTGGAGAAGATACTAGCAATGATGAAGTAAAGGACACAAACACCTTTACT<br>GTGGGAGTTGTTATAAGTAAATGGCACGTGTCA (SEQ ID NO: 275) | 2541 |
| pARBI-671:<br>RTRAF_1_E<br>xogenous_4<br>9 | TTGTATATCCTTTTTAAAGTTATTCTTTTTAGTTAATTGCTCTATGTGTATTGAGACTA<br>GGAATCAGAAAGCTTAGATTCTAGTCCCAGGTGTAAGTTGTGTAACCCTTGGCAAGT<br>GTCAATCTCTAGGCCTCAGCTTTCTCATCTATAAAATGAGGAAGTTGTCGTATTCTAT<br>TTTTTTTCTTAAGATGATACACTTAAATGTTCCCTCTGTTGGGTTATATAATTGCATC<br>AAAAGTGTAGTAATGTTATTAAAAAATTGTTAGAGATCCAAACTAAGGTCTCTTTCA<br>ACTCTCCCATTCTTTTTTCTGTGACTTTATGGTAATAATGAAACTGGTGGTTTTCTTTT<br>CTTCCCCCTCACAGTATCTCAGAGATGTTAACTTGCCTTTCAAGATTCAAGATCGACA<br>AGAAGCTATTGACTGGCTTCTTGGTTTAGCTGTTAGACTTGAAtgacgactgtgccttctagt<br>tgccagccatctgttgtttgcccctcccccgtgccttccttgaccctggaaggtgccactcccactgtcctttccta<br>ataaaatgaggaaattgcatcgcattgtctgagtaggtgtcattctattctgggggtggggtggggcaggaca<br>gcaaggggggaggattgggaagacaatagcaggcatgctggggatgcggtgggctctatggGGATCTGCG<br>ATCGCTCCGGTGCCCGTCAGTGGGCAGAGCGCACATCGCCCACAGTCCCCGAGAAG | 2541 |

TABLE 5-continued

CONSTRUCTS USED FOR EVALUATION OF PREDICTED LOCI

| Construct name | Sequence | Length |
|---|---|---|
| | TTGGGGGGAGGGGTCGGCAATTGAACGGGTGCCTAGAGAAGGTGGCGCGGGGTA<br>AACTGGGAAAGTGATGTCGTGTACTGGCTCCGCCTTTTTCCCGAGGGTGGGGGAGA<br>ACCGTATATAAGTGCAGTAGTCGCCGTGAACGTTCTTTTTCGCAACGGGTTTGCCGC<br>CAGAACACAGCTGAAGCTTCGAGGGGCTCGCATCTCTCCTTCACGCGCCCGCCGCCC<br>TACCTGAGGCCGCCATCCACGCCGGTTGAGTCGCGTTCTGCCGCCTCCCGCCTGTGG<br>TGCCTCCTGAACTGCGTCCGCCGTCTAGGTAAGTTTAAAGCTCAGGTCGAGACCGGG<br>CCTTTGTCCGGCGCTCCCTTGGAGCCTACCTAGACTCAGCCGGCTCTCCACGCTTTGC<br>CTGACCCTGCTTGCTCAACTCTACGTCTTTGMCGTTTTCTGTTCTGCGCCGTTACAG<br>ATCCAAGCTGTGACCGGCGCCTACTCTAGAGCTAGCGAATTgccgccaccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcattttttcactgcattctagttgtggtttgtcc<br>aaactcatcaatgtatcttatTATGGAGATAATGGTACGTTTTGTGGGGAATGTGTATTTTA<br>AAGAGAGAGGAAAGATGGGAAAGGGAGTGTGAAAATGTAGGGAACTTTGCAGTTT<br>GTTTTGTCTAGTACTATTTTACCTTTGGTTTATTCTTATCACAAGTTAAAAGCACTTTT<br>ATTGTCTTTCATTGGTGTTTATATATTTCTGTTAGAATTTGGAAATGGTGCCCTCTGG<br>AGAAGGCTAATTGACTGTCTTCTCACAGAGTAACACTACTTTGATAATATGGTCTGC<br>ACCTTAGCCTTTCAAATTAAATTGTTTTTAGTGTCCCAGAATTGATGGGACTTTGAAG<br>TGTTGTTGCAGTAGGTAATTTCTCAAAAGACTGAAACATGTCTAATGCCAATATACAT<br>TAATACTCTATAGGCCAGAATATATTACTTATGTTTACTGTCTTAGCACAGATACTTCT<br>ATGGT (SEQ ID NO: 276) | |
| pARBI-672:<br>RTRAF_2_E<br>xogenous_5<br>0 | GCACCTGTTATGTAGGAGGAGTAATAAAATGAATGAATGCACTCAAAACACTAAAC<br>AGTAATTCTGTAATCCAACGGGAGGTACAGCGAATACCAAAAGCCTACATATACTAT<br>TCTCTGCATGCTATAGCAAGAAAGAAAGGAAAGTGGCTTCCCGGTGGTTTTCTGCCT<br>ATTGTACAACCAGGAAGCTGACAATAAAGTTTATTTGAGCGTCAGCTTCCCTAGCGAC<br>GTGGCCCCGCCTCCCCAGCCGGAGCCGCGATTGGTGGGCATTTGCCGGCGGCCACC<br>GCTTTTAAGCCACGATTGGCGAAGGCCGCCGTCATTTCGGAGCGACTCAGCGCCTGC<br>CCGCCCTCTCGCCGCGTCGCCGGTGCCTGCGCCTCCCGCTCCACCTCGCTTCTTCTCT<br>CCCGGCCGAGGCCCGGGGGACCAGAGCGAGAAGCGGGGACCATGTTCCGACGCtg<br>acgactgtgccttctagttgccagccatctgttgtttgcccctccccgtgccttccttgacctggaaggtgccac<br>tcccactgtccttttcctaataaaatgaggaaattgcatcgcattgtctgagtaggtgtcattctattctgggggt<br>ggggtggggcaggacagcaaggggggaggattgggaagacaatagcaggcatgctgggatgcggtgggctc<br>tatggGATCTGCGATCGCTCCGGTGCCCGTCAGTGGGCAGAGCGCACATCGCCCAC<br>AGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGC<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttcactgc<br>attctagttgtggtttgtccaaactcatcaatgtatcttatAAGTTGACGGCTCTCGACTACCACAAC<br>CCCGCCGCTTCAACTGCAAAGGTGAGGCGGCCGCCTCAGCCCGGCCGCGTGTCC<br>TGACCTGGGCGGAGGTCCCAGCCTCAGTGCCCGCACCCCACCTCCCCGTCGGGACCC<br>TCGGCGGCCTGGTTTCCGCCGGCAGCCTCCGGGCCCCTCTCCTCTGGGTCGCCACGT<br>ACCTCGGCTCTTCGCCGCCCCTTCCCGCCTTTAAAGCCCTCTCACCTACTCCTGTCTCG<br>GCATGTTACTTTCTGCACTTGCTTAACTCCAAGCATCACGTAACTACCTTCTCTGTACA<br>TAAAAGGGAGAGCATTCGTCTTTCTCACTCACTATTCAACTCCATGGTTCCCTGGGTA | 2541 |

TABLE 5-continued

CONSTRUCTS USED FOR EVALUATION OF PREDICTED LOCI

| Construct name | Sequence | Length |
| --- | --- | --- |
| | ATTAGGCGATACCTTGAGCACCTGCTAATTATGGGCCAGCGCGGTGCTGGATTCTGA<br>GGAAGGTGCTGAGTAACTTG (SEQ ID NO: 277) | 2541 |
| pARBI-673:<br>RTRAF_3_E<br>xogenous_5<br>1 | CACTAAACAGTAATTCTGTAATCCAACGGGAGGTACAGCGAATACCAAAAGCCTACA<br>TATACTATTCTCTGCATGCTATAGCAAGAAAGAAAGGAAAGTGGCTTCCCGGTGGTT<br>TTCTGCCTATTGTACAACCAGGAAGCTGACAATAAAGTTTATTTGAGCGTCGACGTG<br>CGCCGACGTGGCCCCGCCTCCCCAGCCGGAGCCGCGATTGGTGGGCATTTGCCGGC<br>GGCCACCGCTTTTAAGCCACGATTGGCGAAGGCCGCCGTCATTTCGGAGCGACTCA<br>GCGCCTGCCCGCCCTCTCGCCGCGTCGCCGGTGCCTGCGCCTCCCGCTCCACCTCGC<br>TTCTTCTCTCCCGGCCGAGGCCCGGGGGACCAGAGCGAGAAGCGGGGACCATGTTC<br>CGACGCAAGTTGACGGCTCTCGACTACCACAACCCCGCCGGCTTCAACTGCAAAtgac<br>gactgtgccttctagttgccagccatctgttgtttgcccctcccccgtgccttccttgaccctggaaggtgccactc<br>ccactgtcctttcctaataaaatgaggaaattgcatcgcattgtctgagtaggtgtcattctattctgggggggtgg<br>ggtggggcaggacagcaaggggaggattgggaagacaatagcaggcatgctggggatgcggtgggctcta<br>tggGGATCTGCGATCGCTCCGGTGCCCGTCAGTGGGCAGAGCGCACATCGCCCACAG<br>TCCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcattttttttcactgcattctag<br>ttgtgggtttgtccaaactcatcaatgtatcttatGGTGAGGCGGCGGCCTCAGCCCGGCCGCGTG<br>TCCCTGACCTGGGCGGAGGTCCCAGCCTCAGTGCCCGCACCCCACCTCCCCGTCGGG<br>ACCCTCGGCGGCCTGGTTTCCGCCGGCAGCCTCCGGGCCCCTCTCCTCTGGGTCGCC<br>ACGTACCTCGGCTCTTCGCCGCCCCTTCCCGCCTTTAAAGCCCTCTCACCTACTCCTGT<br>CTCGGCATGTTACTTTCTGCACTTGCTTAACTCCAAGCATCACGTAACTACCTTCTCTG<br>TACATAAAAGGGAGAGCATTCGTCTTTCTCACTCACTATTCAACTCCATGGTTCCCTG<br>GGTAATTAGGCGATACCTTGAGCACCTGCTAATTATGGGCCAGCGCGGTGCTGGAT<br>TCTGAGGAAGGTGCTGAGTAACTTGAAGACTAGTTCACTGCCTGCCAGGAGCTAAA<br>GGGACGAGGGGTGGAAG (SEQ ID NO: 278) | 2541 |
| pARBI-674:<br>SERF2_1_Ex<br>ogenous_5<br>2 | CCGGGTTAGGCATAGGCCCTCCCGGATCTTCCGCGGTGTAAGGAGAAGGCCAGCGC<br>CCCTGTGATAGGCCCAGAGCCCCCACTCCACAAGCCAGCCCATCCCCCACGGAGACC<br>CAAACCGTCCACACACACCTTGCCAGCTGTTTGGGCCCCACGCCGCCCCAAAACACG<br>CCTCCAGCTGGCCCCTTGGGACCTCCCTTCTCAGTCCGTATTTTGACCTGGCCCGTG<br>GCAGATTCGCCACTCCCCCCTACCCCAAGCAGCCTGGGCCTCGATGGGCCGTTGTCG<br>GGGCCCGGAGATTGAAGTGGTGTTGGATCCTGCTGCTGGCGCGCTGGGGTAGAA<br>GGGTCGCCGGTGTGTGGGCAGAGCGGCCCCCGCGTCTCACCTTTAATTTTCTTTCCT<br>TAGGCGGTAACCAGCGTGAGCTCGCCCGCCAGAAGAATATGAAAAAGCAGAGCtga<br>cgactgtgccttctagttgccagccatctgttgtttgcccctcccccgtgccttccttgaccctggaaggtgccact<br>cccactgtcctttcctaataaaatgaggaaattgcatcgcattgtctgagtaggtgtcattctattctgggggggtg<br>gggtggggcaggacagcaaggggaggattgggaagacaatagcaggcatgctggggatgcggtgggctct<br>atggGGATCTGCGATCGCTCCGGTGCCCGTCAGTGGGCAGAGCGCACATCGCCCACA<br>GTCCCCGAGAAGTTGGGGGGAGGGGTCGGCAATTGAACGGGTGCCTAGAGAAGGT<br>GGCGCGGGGTAAACTGGGAAAGTGATGTCGTGTACTGGCTCCGCCTTTTTCCCGAG<br>GGTGGGGGAGAACCGTATATAAGTGCAGTAGTCGCCGTGAACGTTCTTTTTCGCAA<br>CGGGTTTGCCGCCAGAACACAGCTGAAGCTTCGAGGGGCTCGCATCTCTCCTTCACG<br>CGCCCGCCGCCCTACCTGAGGCCGCCATCCACGCCGGTGAGTCGCGTTCTGCCGCC<br>TCCCGCCTGTGGTGCCTCCTGAACTGCGTCCGCCGTCTAGGTAAGTTTAAAGCTCAG<br>GTCGAGACCGGGCCTTTGTCCGGCGCTCCCTTGGAGCCTACCTAGACTCAGCCGGCT<br>CTCCACGCTTTGCCTGACCCTGCTTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG | 2541 |

TABLE 5-continued

CONSTRUCTS USED FOR EVALUATION OF PREDICTED LOCI

| Construct name | Sequence | Length |
|---|---|---|
| | AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcattttttttcactgcattctag<br>ttgtggtttgtccaaactcatcaatgtatcttatGACTCGGTTAAGGGAAAGCGCCGAGATGACG<br>GGCTTTCTGCTGCCGCCCGCAAGCAGAGGTAGCCCCAGGGAGGGGAGGGAAAGGG<br>ACGGTGGAGACCTGGGTTAGACCAAGGGTTATAGAAGGAAAGAGAGCTACCTCAG<br>GGCTTGAATGTGGACTAGTCGTGAGGAGCAGAGTGCATTGCTTCCTCTAGGGTTTTA<br>TTTCCTCCCCACCCTCCAAATTGTTAGCTCACAGCCTTACAGGAAAGGACGGGGGCG<br>GGCGCCTGCCCTCAGTCTGATTTCTGAGCGTCCCTGGGTCTGACCTTAAGGGCAAGG<br>GCAGGGAGCTTCACATTTCAAATACAGTTGTGGTTACGGCAGCCCAGTACTTTTGGC<br>CCTCCTTGCTGTTCGGTTCTCCTCCCTTCTCCCAACCTCCTCCACTGGTGTTGCTGGGTG<br>TGGTCCTCAATACAGAATAGAG (SEQ ID NO: 279) | |
| pARB1-675:<br>SERF2_2_Ex<br>ogenous_5<br>3_54 | AATCGAGCCCTTTGCCCACGGCTACTTCACGGGACCACCCTCCCGGGTTAGGCATAG<br>GCCCTCCCGGATCTTCCGCGGTGTAAGGAGAAGGCCAGCGCCCTGTGATAGGCCC<br>AGAGCCCCCACTCCACAAGCCAGCCCATCCCCACGGAGACCCAAACCGTCCACACA<br>CACCCTTGCCAGCTGTTTGGGCCCCACGCCGCCCCAAAACACGCCTCCAGCTGGCCCC<br>TTGGGACCTCCCTTCTCAGTCCGTATTTTGACCTGGCCCGTGGCAGATTCGCCACTC<br>CCCCCTACCCCAAGCAGCCTGGGCCTCGATGGGCCGTTGTCGGGGCCCGGAGATTG<br>AAGTGGTGTTGGATCCTGCTGCTGGCCGCGCTGGGGTAGAAGGGTCGCCGGTGTGT<br>GGGCAGAGCGGCCCCCGCGTCTCACCTTTAATTTTCTTTCCTTAGGCGGTAACtgacga<br>ctgtgccttctagttgccagccatctgttgtttgccctccccgtgccttcttgacctggaaggtgccactccc<br>actgtcctttcctaataaaatgaggaaattgcatcgcattgtctgagtaggtgtcattctattctgggggtgggg<br>tggggcaggacagcaaggggaggattgggaagacaatagcaggcatgctgggatgcggtgggctctatg<br>gGGATCTGCGATCGCTCCGGTGCCCGTCAGTGGGCAGAGCGCACATCGCCCACAGT<br>CCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCTACCTAGACTCAGCCGGCTC<br>TCCACGCTTTGCCTGACCCTGCTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcattttttttcactgcattctag<br>ttgtggtttgtccaaactcatcaatgtatcttatCAGCGCGAGCTTGCCCGCCAGAAGAATATGAA<br>AAAGCAGAGCGACTCGGTTAAGGGAAAGCGCCGAGATGACGGGCTTTCTGCTGCC<br>GCCCGCAAGCAGAGGTAGCCCCAGGGAGGGGAGGGAAAGGGACGGTGGAGACCT<br>GGGTTAGACCAAGGGTTATAGAAGGAAAGAGAGCTACCTCAGGGCTTGAATGTGG<br>ACTAGTCGTGAGGAGCAGAGTGCATTGCTTCCTCTAGGGTTTTATTTCCTCCCCACCC<br>TCCAAATTGTTAGCTCACAGCCTTACAGGAAAGGACGGGGGCGGGCGCCTGCCCTC<br>AGTCTGATTTCTGAGCGTCCCTGGGTCTGACCTTAAGGGCAAGGGCAGGGAGCTTC<br>ACATTTCAAATACAGTTGTGGTTACGGCAGCCCAGTACTTTTGGCCCTCCTTGCTGTT<br>CGGTTCTCCTCCCTTCTCCCAACCTC (SEQ ID NO: 280) | 2541 |
| pARB1-676:<br>SLC38A1_1<br>_Exogenous<br>_55 | TTCAAAAGGAATCTTTTTGTTTCAACTATTAGGATCTTTTTAAATCAAATATGTATTTT<br>AATGGTGTACACCAGACCTGAAGAAAAAGATCACAGAAGGAATTTCCCCTTTGTAA<br>GATAGAGGTAGTTAAAAATAAGCCTTATGACCTAATAGGTTAATTGTAATGCTCTGG<br>TAGCCAACTTGAAAAGGAGAAATGATGGTTGCATCTCACATTTTAAAATGTTAAGA<br>ATTTGTTTTGTAATGAGGATACCTTAACCCCTGAAGGCCAAAATGACTATTTGTGTGA<br>GTTTGAGAAAGGCACATAGTAACTTGGGGAACAGTCAATAGAATGACAAAATCTTG<br>ACTATTTTAACTTTCTGAACCCTGTCATTTGTTTGATTTTTAAATAG<br>GCTGCATGGTGTATGAAAAGCTGGGGAACAAGTCTTTGGCACCACAtgacgactgtgc<br>cttctagttgccagccatctgttgtttgccctccccgtgccttcttgacctggaaggtgccactcccactgtc<br>ctttcctaataaaatgaggaaattgcatcgcattgtctgagtaggtgtcattctattctgggggtgggtgggg<br>caggacagcaaggggaggattgggaagacaatagcaggcatgctgggatgcggtgggctctatggGGA<br>TCTGCGATCGCTCCGGTGCCCGTCAGTGGGCAGAGCGCACATCGCCCACAGTCCCC | 2541 |

TABLE 5-continued

CONSTRUCTS USED FOR EVALUATION OF PREDICTED LOCI

| Construct name | Sequence | Length |
|---|---|---|
| | GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC<br>GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGGCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcattttttcactgcattctagttgtggtt<br>tgtccaaactcatcaatgtatcttatGGGAAGTTCGTAATCTTTGGAGCCACCTCTCTACAGAA<br>CACTGGAGGTAAAAAGAACATGTTTTCTTTACATAACTTGAAACTAATTCTGGTGG<br>ATGAGCGGCCACATGAATTTTAACATAATTCAAGCAGTTATCATCCTCATTGCTAAAA<br>TGGCACAGGGAAAGTAAAGCAGAGACAGCAGTCACTTATTTAAAGCCACAAATCCT<br>GCTAGAGTAGCTGAAGTTGCCTTTGTGTCTTACTGACAGTTGGTCTAAGAACGGGCT<br>GATAACTTTTTATGTAGCTTGCAACATAAGCCTTCGTATCTTCTTTCTAAAAATGTTCT<br>CATTTTCCTTCAGCAATGCTGAGCTACCTCTTCATCGTAAAAATGAACTACCCTCTG<br>CCATAAAGTTTCTAATGGGAAAGGAAGAGACATTTTCGTAAGTTATAGACCATTTTT<br>TTATGATATA (SEQ ID NO: 281) | |
| pARBI-677:<br>SLC38A1_2<br>_Exogenous<br>_56_57 | TAAAGATGTCAAGCTTCAAATCATTATCATAAGGTTAAATATATTACGCATGTCTTTA<br>CAGCAAGTTTATTTCTGATCGTGAAAGTAGAAGAAGTCTCACAAACAGCCATTTGA<br>AAAAAAGAAGTGTGATGAGTATGTAAGTATCATTATAATGAAGTATGCTTATTTTTTT<br>AATCATATAAATTGGGACAAATCTTTTTAATTCAAGTAGCATAGTACCAAAAGCATA<br>ACTACCTGTATTCACCAGGATATTCCTCATACCTTATGTATTTTCTCTTGAAATCCATT<br>CAAGGAAATAACTAGATAACTAAGAATGGATTTTCTTGAATTTTACTTCCATATTGGT<br>TCCTGAGAGTGCATTAAAGGCTTTGGCTTGATGAACTTTCTGTTGGGGATTATTTTGCTT<br>AGTGTCAATGTTTGTTTCTTTGTTCAGATTCCAGGTACAACCTCCtgacgactgtgccttcta<br>gttgccagccatctgttgtttgccctcccccgtgccttccttgaccctggaaggtgccactcccactgtcctttcc<br>taataaaatgaggaaattgcatcgcattgtctgagtaggtgtcattctattctgggggtgggtgggcagga<br>cagcaaggggaggattgggaagacaatagcaggcatgctggggatgcggtgggctctatggGGATCTG<br>CGATCGCTCCGGTGCCCGTCAGTGGGCAGAGCGCACATCCCCCACAGTCCCCGAGA<br>AGTTGGGGGGAGGGGTCGGCAATTGAACGGGTGCCTAGAGAAGGTGGCGCGGGG<br>TAAACTGGGAAAGTGATGTCGTGTACTGGCTCCGCCTTTTTCCCGAGGGTGGGGGA<br>GAACCGTATATAAGTGCAGTAGTCGCCGTGAACGTTCTTTTTCGCAACGGGTTTGCC<br>GCCAGAACACAGCTGAAGCTTCGAGGGGCTCGCATCTCTCCTTCACGCGCCCGCCGC<br>CCTACCTGAGGCCGCCATCCACGCCGGTTGAGTCGCGTTCTGCCGCCTCCCGCCTGT<br>GGTGCCTCCTGAACTGCGTCCGCCGTCTAGGTAAGTTTAAAGCTCAGGTCGAGACCG<br>GGCCTTTGTCCGGCGCTCCCTTGGAGCCTACCTAGACTCAGCCGGCTCTCCACGCTTT<br>GCCTGACCCTGCTTGCTCAACTCTACGTCTTTGTTTCGTTTTCTGTTCTGCGCCGTTAC<br>AGATCCAAGCTGTGACCGGCGCCTACTCTAGAGCTAGCGAATTgccgccaccATGGTG<br>AGCAAGGGCGAGGAGCTGTTCACCGGGGTGGTGCCCATCCTGGTCGAGCTGGACG<br>GCGACGTAAACGGCCACAAGTTCAGCGTGTCCGGCGAGGGCGAGGGCGATGCCAC<br>CTACGGCAAGCTGACCCTGAAGTTCATCTGCACCACCGGCAAGCTGCCCGTGCCCTG<br>GCCCACCCTCGTGACCACCCTGACCTACGGCGTGCAGTGCTTCAGCCGCTACCCCGA<br>CCACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACC<br>GCCGCCGGGATCACTCTCGGCATGGACGAGCTGTACAAatgattgtttattgcagcttataatgg<br>ttacaaataaagcaatagcatcacaaatttcacaaataaagcattttttcactgcattctagttgtggtttgtcc<br>aaactcatcaatgtatcttatTTAGGCATGTCAGTTTTAACCTAAGCAACGCCATTATGGGC<br>AGTGGGATTTTGGGACTCGCCTTTGCCCTGGCAAACACTGGAATCCTACTTTTTCTGT<br>GAGTATTGACGTGCCGGTACTTTCCATTTTAAAACTGAACTTTTTGTATGTTTCTGTTA<br>TTACATAGAAGAAATGTGAAATATTTATAAATAGTTTTTTTATTAACTTGGCTAAGTT | 2541 |

TABLE 5-continued

CONSTRUCTS USED FOR EVALUATION OF PREDICTED LOCI

| Construct name | Sequence | Length |
|---|---|---|
| | ACAAGTACATACTTTGATATTTATTGCTTGAGTGATMCCAAACTGTACCTAATGCTT<br>ACAACAAAGAGGAAGGAGAAAATCTTTTTATTAATCAAAAATACTGAAATAAGCATT<br>TGTGAAAAGGATTAAAACATTTGAAAATAACTTTTTTTGGTATTTTTGGAGTCTACCT<br>GTGACTTTAAATCTCAGTTAAAATATTAAGAGGTGTTTAACCCCAGCCAGTCACCACT<br>T (SEQ ID NO: 282) | |
| pARBI-678:<br>SMAD2_1_<br>Exogenous_<br>58 | ATCATTCTTCACACTAGTTCCTTTTCTGACTCTTCAGTCACCTCCAGAATTAATATCCTT<br>AGAAGCATCTCTAAAATGAGTTTGATTTACTAAACATAGAAGTTGACAAAGTTTTTC<br>AAGTATAACTGCATAAACTCTCTTTTTTAAAAAATCAGTTTTTCCCAAGTTGTTAGCCT<br>TTCATTGGCATTTGAGTCATTTATGTGACATATTTATAAGAAACATCTGCTAGTGCTG<br>CTGCATACTTTTATCAGATCCATTAAATAGTACATTTTTGTTCTTGATTCTCACTAAAA<br>CTAACTAAATGGCTGTCATTCTTTTCTTTATGCTTTTATTGTACTAATTTAGCCCATTTG<br>ACTGCACtttttttttttttttttttAAAGTTCCCTCCTTTCTTTTCCCCTTGCTTCCCAACAGGTC<br>TCTTGATGGTCGTCTCCAGGTATCCCATCGAtgacgactgtgccttctagttgccagccatctgttg<br>tttgcccctccccgtgccttccttgaccctggaaggtgccactcccactgtcctttcctaataaaatgaggaaat<br>tgcatcgcattgtctgagtaggtgtcattctattctgggggggtggggtggggcaggacagcaaggggaggatt<br>gggaagacaatagcaggcatgctggggatgcggtgggctctatggGGATCTGCGATCGCTCCGGTG<br>CCCGTCAGTGGGCAGAGCGCACATCGCCCACAGTCCCCGAGAAGTTGGGGGGAGG<br>GGTCGGCAATTGAACGGGTGCCTAGAGAAGGTGGCGCGGGGTAAACTGGGAAAGT<br>GATGTCGTGTACTGGCTCCGCCTTTTTCCCGAGGGTGGGGGAGAACCGTATATAAGT<br>GCAGTAGTCGCCGTGAACGTTCTTTTTCGCAACGGGTTTGCCGCCAGAACACAGCTG<br>AAGCTTCGAGGGGCTCGCATCTCTCCTTCACGCGCCCGCCGCCCTACCTGAGGCCGC<br>CATCCACGCCGGTTGAGTCGCGTTCTGCCGCCTCCCGCCTGTGGTGCCTCCTGAACT<br>GCGTCCGCCGTCTAGGTAAGTTTAAAGCTCAGGTCGAGACCGGGCCTTTGTCCGGC<br>GCTCCCTTGGAGCCTACCTAGACTCAGCCGGCTCTCCACGCTTTGCCTGACCCTGCTT<br>GCTCAACTCTACGTCTTTGTTTCGTTTTCTGTTCTGCGCCGTTACAGATCCAAGCTGTG<br>ACCGGCGCCTACTCTAGAGCTAGCGAATTgccgccaccATGGTGAGCAAGGGCGAGGA<br>GCTGTTCACCGGGGTGGTGCCCATCCTGGTCGAGCTGGACGGCGACGTAAACGGCC<br>ACAAGTTCAGCGTGTCCGGCGAGGGCGAGGGCGATGCCACCTACGGCAAGCTGAC<br>CCTGAAGTTCATCTGCACCACCGGCAAGCTGCCCGTGCCCTGGCCCACCCTCGTGAC<br>CACCCTGACCTACGGCGTGCAGTGCTTCAGCCGCTACCCCGACCACATGAAGCAGCA<br>CGACTTCTTCAAGTCCGCCATGCCCGAAGGCTACGTCCAGGAGCGCACCATCTTCTT<br>CAAGGACGACGGCAACTACAAGACCCGCGCCGAGGTGAAGTTCGAGGGCGACACC<br>CTGGTGAACCGCATCGAGCTGAAGGGCATCGACTTCAAGGAGGACGGCAACATCCT<br>GGGGCACAAGCTGGAGTACAACTACAACAGCCACAACGTCTATATCATGGCCGACA<br>AGCAGAAGAACGGCATCAAGGTGAACTTCAAGATCCGCCACAACATCGAGGACGGC<br>AGCGTGCAGCTCGCCGACCACTACCAGCAGAACACCCCCATCGGCGACGGCCCCGT<br>GCTGCTGCCCGACAACCACTACCTGAGCACCCAGTCCAAGCTGAGCAAAGACCCCAA<br>CGAGAAGCGCGATCACATGGTCCTGCTGGAGTTCGTGACCGCCGCCGGGATCACTC<br>TCGGCATGGACGAGCTGTACAAAtgattgtttattgcagcttataatggttacaaataaagcaatagc<br>atcacaaatttcacaaataaagcatttttttcactgcattctagtttgtggtttgtccaaactcatcaatgtatctta<br>tAAAGGATTGCCACATGTTATATATTGCCGATTATGGCGCTGGCCTGATCTTCACAGT<br>CATCATGAACTCAAGGCAATTGAAAACTGCGAATATGCTTTTAATCTTAAAAAGGAT<br>GAAGTATGTGTAAACCCTTACCACTATCAGAGAGTTGAGACACAGGTAGGAATATT<br>GCAAGTTTTTTTCTTGGTTTTGAATTAAATGCCTGAACTTCAGTATATTTAAGTACTCT<br>TGTGACCCAGGAAAATTTTAGTGTAAATTCTAATAAATTACCTTAAATTGTGCATATT<br>ATTTGGTGGTAATTAAAAtttttttatttttaaaaattttttAATGAGAAAACATATCTGTTTCTT<br>GGAATAGCATATGATTTGGCATGAAAGTGCATATCCAGGAAATCCTGTAGATTGGC<br>AGTCTGCTCAGCGCTATGCTGATGTGCTTCTACATGTCCCT (SEQ ID NO: 283) | 2541 |
| pARBI-679:<br>SMAD2_2_<br>Exogenous_<br>59 | TTCTATATTAAAAATCAGTTGACATCTGTTTTTAGATAATTTTTTAAAAAACTGGATTA<br>TAAAATGAAGCACTTAGTAAAGCTGATGGCAGAGGTTTAGATCTTTTGAATACAGG<br>AAAGTGGTAAGGGCATTATAGGTATGATTCATTGAGCTAGAGGGGCTTGGTGTTCA<br>CATTTTAAAAACATAATCATGACTTATCTGGAGTCACATGTTCCATTTTATTGGCTTCC<br>TTCATATAGAAAATATAGTAACCAGCACTACATGCCTGTGAAAAGTGAAGCAATTG<br>TATATTTTCTGGGTGAAGGAAGTATTCTGTACATTCTCCATGTTTTACATCATGGTATT<br>TTGAATAACCATGCTTCCATGTTCACATCAATTTTTTGTTTTTCAATTTATGCACAGCA<br>CTTGCTCTGAAATTTGGGGACTGAGTACACCAAATACGATAGATgacgactgtgccttcta<br>gttgccagccatctgttgtttgcccctccccgtgccttccttgaccctggaaggtgccactcccactgtcctttcc<br>taataaaatgaggaaattgcatcgcattgtctgagtaggtgtcattctattctgggggggtggggtggggcagga<br>cagcaaggggaggattgggaagacaatagcaggcatgctggggatgcggtgggctctatggGGATCTG<br>CGATCGCTCCGGTGCCCGTCAGTGGGCAGAGCGCACATCGCCCACAGTCCCCGAGA<br>AGTTGGGGGGAGGGGTCGGCAATTGAACGGGTGCCTAGAGAAGGTGGCGCGGGG<br>TAAACTGGGAAAGTGATGTCGTGTACTGGCTCCGCCTTTTTCCCGAGGGTGGGGGA<br>GAACCGTATATAAGTGCAGTAGTCGCCGTGAACGTTCTTTTTCGCAACGGGTTTGCC<br>GCCAGAACACAGCTGAAGCTTCGAGGGGCTCGCATCTCTCCTTCACGCGCCCGCCGC<br>CCTACCTGAGGCCGCCATCCACGCCGGTTGAGTCGCGTTCTGCCGCCTCCCGCCTGT<br>GGTGCCTCCTGAACTGCGTCCGCCGTCTAGGTAAGTTTAAAGCTCAGGTCGAGACCG<br>GGCCTTTGTCCGGCGCTCCCTTGGAGCCTACCTAGACTCAGCCGGCTCTCCACGCTTT<br>GCCTGACCCTGCTTGCTCAACTCTACGTCTTTGTTTCGTTTTCTGTTCTGCGCCGTTAC<br>AGATCCAAGCTGTGACCGGCGCCTACTCTAGAGCTAGCGAATTgccgccaccATGGTG<br>AGCAAGGGCGAGGAGCTGTTCACCGGGGTGGTGCCCATCCTGGTCGAGCTGGACG<br>GCGACGTAAACGGCCACAAGTTCAGCGTGTCCGGCGAGGGCGAGGGCGATGCCAC<br>CTACGGCAAGCTGACCCTGAAGTTCATCTGCACCACCGGCAAGCTGCCCGTGCCCTG<br>GCCCACCCTCGTGACCACCCTGACCTACGGCGTGCAGTGCTTCAGCCGCTACCCCGA | 2541 |

TABLE 5-continued

CONSTRUCTS USED FOR EVALUATION OF PREDICTED LOCI

| Construct name | Sequence | Length |
|---|---|---|
| | CCACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatCAGTGGGATACAACAGGCCTTTACAGCTTCTCTGAACAAAC<br>CAGGTGAATATTCTGCCCTCTGTCGAATCTTAGAGATCTTGTGGGGAGGGGGGTATAT<br>TTTGAAAGACCTATATGGGGTTGCTTAGTATAATTTTGCCTAGGATGTTTCCTTAATG<br>TAAAATAAGGCATAGCATTTAAAATATCTGCTTGCCAGTATAAAAAATATATTAAAT<br>GTTTCAGCTGATGTTTTAATCAATGCAATTCTAGTTTGAATCTTCTTTAAATTACTGTA<br>TCCCCTAAAGAATAATTTTGATAACTATATATTTATTTTAGCTTGAGATCAGATTA<br>TAATCTGTTGTTGGCCTAATTTTTAAGTAGATACATGATGAGTTTTGCTAAATTTCTTG<br>TTATCAGAATCTCATCTTTATACTAATAAATACATACTTAATGAACCCCTTATATCACA<br>A (SEQ ID NO: 284) | |
| pARBI-680:<br>SMAD2_3_<br>Exogenous_<br>60 | TCAATGTATTTTTGTATAGTCTTTTGAGATTAGAGTGAAGTTCTAAAAAGTAAGAGA<br>ACCTTTTGTGAAAATATTTTAATTGACACTACTAAGAGTTTAAAATAGTATTGGTGGT<br>GAAAAATCGTTAAAAGTATCTGATTTTACTTGCAAAATTACTGTATTTTCCCACAAGA<br>GGAGTCCTTACAACATTCTTGTTTTTAGAGGGGTTTGTTTCCATCATTCATTTAAATTC<br>ATAAAGATAACGTTTTCATGGGTGGAGAAGTCTATTGGGAAAGTCATAATTTCGAATT<br>TCTATCTTGCTTTGCAGTTTGCTTTCTATGATAAGTTGAAATTATTACTTGATGTTCAA<br>GGTAGTCTCTACATCATCCTTTCAATATTTCTGCTAGGTTCGATACAAGAGGCTGTTT<br>TCCTAGCGTGGCTTGCTGCCTTTGGTAAGAACATGTCGTCCATCtgacgactgtgccttcta<br>gttgccagccatctgttgtttgcccctccccgtgccttccttgaccctggaaggtgccactcccactgtcctttcc<br>taataaaatgaggaaattgcatcgcattgtctgagtaggtgtcattctattctgggggtggggtggggcagga<br>cagcaaggggggaggattgggaagacaatagcaggcatgctggggatgcggtgggctctatggGGATCTG<br>CGATCGCTCCGGTGCCCGTCAGTGGGCAGAGCGCACATCGCCCACAGTCCCCGAGA<br>AGTTGGGGGGAGGGGTCGGCAATTGAACGGGTGCCTAGAGAAGGTGGCGCGGGG<br>TAAACTGGGAAAGTGATGTCGTGTACTGGCTCCGCCTTTTTCCCGAGGGTGGGGGA<br>GAACCGTATATAAGTGCAGTAGTCGCCGTGAACGTTCTTTTTTCGCAACGGGTTTGCC<br>GCCAGAACACAGCTGAAGCTTCGAGGGGCTCGCATCTCTCCTTCACGCGCCCGCCGC<br>CCTACCTGAGGCCGCATCCACGCCGGTTGAGTCGCGTTCTGCGCCTCCCGCCTGT<br>GGTGCCTCCTGAACTGCGTCCGCCGTCTAGGTAAGTTTAAAGCTCAGGTCGAGACCG<br>GGCCTTTGTCCGGCGCTCCCTTGGAGCCTACCTAGACTCAGCCGGCTCTCCACGCTTT<br>GCCTGACCCTGCTTGCTCAACTCTACGTCTTTGTTTCGTTTTCTGTTCTGCGCCGTTAC<br>AGATCCAAGCTGTGACCGGCGCCTACTCTAGAGCTAGCGAATTgccgccaccATGGTG<br>AGCAAGGGCGAGGAGCTGTTCACCGGGGTGGTGCCCATCCTGGTCGAGCTGGACG<br>GCGACGTAAACGGCCACAAGTTCAGCGTGTCCGGCGAGGGCGAGGGCGATGCCAC<br>CTACGGCAAGCTGACCCTGAAGTTCATCTGCACCACCGGCAAGCTGCCCGTGCCCTG<br>GCCCACCCTCGTGACCACCCTGACCTACGGCGTGCAGTGCTTCAGCCGCTACCCCGA<br>CCACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatTTGCCATTCACGCCGCCAGTTGTGAAGAGACTGCTGGGATG<br>GAAGAAGTCAGCTGGTGGGTCTGGAGGAGCAGGCGGAGGAGAGCAGAATGGGCA<br>GGAAGAAAAGTGGTGTGAGAAAGCAGTGAAAAGTCTGGTGAAGAAGCTAAAGAAA<br>ACAGGACGATTAGATGAGCTTGAGAAAGCCATCACCACTCAAAACTGTAATACTAAA<br>TGTGTTACCATACCAAGGTAAGTMGTTAGATCCCAGGTTTGATCAAATTATGTCAA<br>GGAATCTGAAGGAAAGTTACTGAATTTGTGTTCCTTTCAAGTTGCCTGTAAAAAGTG<br>ATGATTGAAATATTGACTGTTTTTAACCTTGTATAAATTGTTTTTTGCTAGCTGACTTGTT<br>TTATAAATTATTTTCTTGAATAGTGAGGTTTAATCAAGCTAAATAAGATACTTAGATT<br>TATTATCTTCA (SEQ ID NO: 285) | 2541<br><br><br><br><br><br><br><br><br><br><br><br><br><br><br><br><br><br><br><br><br><br><br><br><br><br><br><br><br><br><br><br><br><br><br><br><br><br><br><br><br><br>2541 |
| pARBI-681:<br>SOCS1_1_E<br>xogenous_6<br>1 | GGGCTCCCGCAGCACAGCCTTTCTCCGGCCCTAGCCCAAATCGCCCAGACCAGGCGC<br>GGATCCCAGCCTGGCCAGCAGGCGGCGGGCGCGGGGCGGCGAGCCGGGGCCGGA<br>CGGCTGGAGCCAGAACCGGCTGCTCTCCACGCCCCCCTCTCGGTGCTGCCCGGAGG<br>CCGGACTCCGCCTCCACCGAGCCCCACCCGCCGGGAAGAGCTCCGCGGAGTACAG<br>AGCCCATTTTCTAGCTGTGTCCACTGAGGCTGAACGGATCCGCGCGGACTTGGTGCT<br>CCGTGCTCGCCCCCTAGGGCCGGGTCCGCCGGGAGCGCCGCCCTCCGGAGTTGTCC<br>GGCCGGCGCACACCTGCCCGGCCCCGCAGCGCCCCAGCTCACCTCTTTGTCTCTCCC<br>GCAGCGCACCCCCGGACGCTATGGCCCACCCCTCCGGCTGGCCCCTTCTGTAGGATG<br>tgacgactgtgccttctagttgccagccatctgttgtttgcccctccccgtgccttccttgaccctggaaggtgcc<br>actcccactgtcctttcctaataaaatgaggaaattgcatcgcattgtctgagtaggtgtcattctattctgggggg | |

TABLE 5-continued

CONSTRUCTS USED FOR EVALUATION OF PREDICTED LOCI

| Construct name | Sequence | Length |
|---|---|---|
| | gtggggtggggcaggacagcaaggggggaggattgggaagacaatagcaggcatgctggggatgcggtgggc<br>tctatggGGATCTGCGATCGCTCCGGTGCCCGTCAGTGGGCAGAGCGCACATCGCCCA<br>CAGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatcttatGTAGCACACAACCAGGTGGCAGCCGA<br>CAATGCAGTCTCCACAGCAGCAGAGCCCCGACGGCGGCCAGAACCTTCCTCCTCTTC<br>CTCCTCCTgccccgcggccccgcgcgcccgcggccgtgccccgcggtcccggccccggCCCCCGGCG<br>ACACGCACTTCCGCACATTCCGTTCGCACGCCGATTACCGGCGCATCACGCGCGCCA<br>GCGCGCTCCTGGACGCCTGCGGATTCTACTGGGGGCCCCTGAGCGTGCACGGGGCG<br>CACGAGCGGCTGCGCGCCGAGCCCGTGGGCACCTTCCTGGTGCGCGACAGCCGCCA<br>GCGGAACTGCTTTTTCGCCCTTAGCGTGAAGATGGCCTCGGGACCCACGAGCATCCG<br>CGTGCACTTTCAGGCCGGCCGCTTTCACCTGGATGGCAGCCGCGAGAGCTTCGACTG<br>CCTCTTCGAGCTGCTG (SEQ ID NO: 286) | |
| pARBI-682:<br>SOCS1_2_E<br>xogenous_6<br>2 | GGATCCCAGCCTGGCCAGCAGGCGGCGGGGCGCGGGGCGGCGAGCCGGGGCCGGA<br>CGGCTGGAGCCAGAACCGGCTGCTCTCCACGCCCCCCTCTCGGTGCTGCCCGGAGG<br>CCCGGACTCCGCCTCCACCGAGCCCCACCCGCCGGGAAGAGCTCCGCGGAGTACAG<br>AGCCCATTTTCTAGCTGTGTCCACTGAGGCTGAACGGATCCGCGCGGACTTGGTGCT<br>CCGTGCTCGCCCCTAGGGCCGGGTCCGCCGGGAGCGCCGCCCTCCGGAGTTGTCC<br>GGCCGGCGCACACCTGCCCGGCCCCGCAGCGCCCCAGCTCACCTCTTTGTCTCTCCC<br>GCAGCGCACCCCCGGACGCTATGGCCCACCCCTCCGGCTGGCCCCTTCTGTAGGATG<br>GTAGCACACAACCAGGTGGCAGCCGACAATGCAGTCTCCACAGCAGCAGAGCCCCG<br>Atgacgactgtgccttctagttgccagccatctgttgtttgccctccccgtgccttccttgaccctggaaggtg<br>ccactcccactgtcctttcctaataaaatgaggaaattgcatcgcattgtctgagtaggtgtcattctattctggg<br>gggtggggtggggcaggacagcaaggggggaggattgggaagacaatagcaggcatgctggggatgcggtgg<br>gctctatggGGATCTGCGATCGCTCCGGTGCCCGTCAGTGGGCAGAGCGCACATCGCC<br>CACAGTCCCCGAGAAGTTGGGGGGAGGGGTCGGCAATTGAACGGGTGCCTAGAGA<br>AGGTGGCGCGGGGTAAACTGGGAAAGTGATGTCGTGTACTGGCTCCGCCTTTTTCC<br>CGAGGGTGGGGGAGAACCGTATATAAGTGCAGTAGTCGCCGTGAACGTTCTTTTTC<br>GCAACGGGTTTGCCGCCAGAACACAGCTGAAGCTTCGAGGGGCTCGCATCTCTCCTT<br>CACGCGCCCGCCGCCCTACCTGAGGCCGCCATCCACGCCGGTTGAGTCGCGTTCTGC<br>CGCCTCCCGCCTGTGGTGCCTCCTGAACTGCGTCCGCCGTCTAGGTAAGTTTAAAGC<br>TCAGGTCGAGACCGGGCCTTTGTCCGGCGCTCCCTTGGAGCCTACCTAGACTCAGCC<br>GGCTCTCCACGCTTTGCCTGACCCTGCTTGCTCAACTCTACGTCTTTGTTTCGTTTTCT<br>GTTCTGCGCCGTTACAGATCCAAGCTGTGACCGGCGCCTACTCTAGAGCTAGCGAAT<br>TgccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatcttatCGGCGGCCAGAACCTTCCTCCTCTTCCT<br>CCTCCTcgccgcggccccgcgcgcccgcggccgtgccccgcggtcccggccccggCCCCCGGCGAC<br>ACGCACTTCCGCACATTCCGTTCGCACGCCGATTACCGGCGCATCACGCGCGCCAGC<br>GCGCTCCTGGACGCCTGCGGATTCTACTGGGGGCCCCTGAGCGTGCACGGGGCGCA<br>CGAGCGGCTGCGCGCCGAGCCCGTGGGCACCTTCCTGGTGCGCGACAGCCGCCAGC | 2541 |

TABLE 5-continued

CONSTRUCTS USED FOR EVALUATION OF PREDICTED LOCI

| Construct name | Sequence | Length |
|---|---|---|
| | GGAACTGCTTTTTCGCCCTTAGCGTGAAGATGGCCTCGGGACCCACGAGCATCCGCG<br>TGCACTTTCAGGCCGGCCGCTTTCACCTGGATGGCAGCCGCGAGAGCTTCGACTGCC<br>TCTTCGAGCTGCTGGAGCACTACGTGGCGGCGCCGCGCCGCATGCTGGGGGCCCCG<br>CTGCGCCAGCGCCGC (SEQ ID NO: 287) | |
| pARBI-683:<br>S0051_3_E<br>xogenous_6<br>3 | CGGACTCCGCCTCCACCGAGCCCCCACCCGCCGGGAAGAGCTCCGCGGAGTACAGA<br>GCCCATTTTCTAGCTGTGTCCACTGAGGCTGAACGGATCCGCGCGGACTTGGTGCTC<br>CGTGCTCGCCCCCTAGGGCCGGGTCCGCCGGGAGCGCCGCCCTCCGGAGTTGTCCG<br>GCCGGCGCACACCTGCCCGGCCCCGCAGCGCCCCAGCTCACCTCTTTGTCTCTCCCG<br>CAGCGCACCCCCGGACGCTATGCCCACCCCTCCGGCTGGCCCCTTCTGTAGGATGG<br>TAGCACACAACCAGGTGGCAGCCGACAATGCAGTCTCCACAGCAGCAGAGCCCCGA<br>CGGCGGCCAGAACCTTCCTCCTCTTCCTCCTcgcccgcggccccgcgcgccccgcggccgtg<br>ccccgcggtcccggccccggCCCCCGGCGACACGCACTTCCGCACAtgacgactgtgccttctagtt<br>gccagccatctgttgtttgccctccccgtgccttccttgacccctggaaggtgccactcccactgtcctttcctaa<br>taaaatgaggaaattgcatcgcattgtctgagtaggtgtcattctattctgggggtggggtggggcaggacag<br>caaggggggaggattgggaagacaatagcaggcatgctgggatgcggtgggctctatggGGATCTGCGA<br>TCGCTCCGGTGCCCGTCAGTGGGCAGAGCGCACATCGCCCACAGTCCCCGAGAAGT<br>TGGGGGGAGGGGTCGGCAATTGAACGGGTGCCTAGAGAAGGTGGCGCGGGGTAA<br>ACTGGGAAAGTGATGTCGTGTACTGGCTCCGCCTTMCCCGAGGGTGGGGGAGAA<br>CCGTATATAAGTGCAGTAGTCGCCGTGAACGTTCTTTTTCGCAACGGGTTTGCCGCC<br>AGAACACAGCTGAAGCTTCGAGGGGCTCGCATCTCTCCTTCACGCGCCCGCCGCCCT<br>ACCTGAGGCCGCCATCCACGCCGGTTGAGTCGCGTTCTGCCGCCTCCCGCCTGTGGT<br>GCCTCCTGAACTGCGTCCGCCGTCTAGGTAAGTTTAAAGCTCAGGTCGAGACCGGG<br>CCTTTGTCCGGCGCTCCCTTGGAGCTACCTAGACTCAGCCGGCTCTCCACGCTTTGC<br>CTGACCCTGCTTGCTCAACTCTACGTCTTTGMCGTTTTCTGTTCTGCGCCGTTACAG<br>ATCCAAGCTGTGACCGGCGCCTACTCTAGAGCTAGCGAATTgccgccaccATGGTGAG<br>CAAGGGCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGCCACCT<br>ACGGCAAGCTGACCCTGAAGTTCATCTGCACCACCGGCAAGCTGCCCGTGCCCTGGC<br>CCACCCTCGTGACCACCCTGACCTACGGCGTGCAGTGCTTCAGCCGCTACCCCGACC<br>ACATGAAGCAGCACGACTTCTTCAAGTCCGCCATGCCCGAAGGCTACGTCCAGGAG<br>CGCACCATCTTCTTCAAGGACGACGGCAACTACAAGACCCGCGCCGAGGTGAAGTT<br>CGAGGGCGACACCCTGGTGAACCGCATCGAGCTGAAGGGCATCGACTTCAAGGAG<br>GACGGCAACATCCTGGGGCACAAGCTGGAGTACAACTACAACAGCCACAACGTCTA<br>TATCATGGCCGACAAGCAGAAGAACGGCATCAAGGTGAACTTCAAGATCCGCCACA<br>ACATCGAGGACGGCAGCGTGCAGCTCGCCGACCACTACCAGCAGAACACCCCCATC<br>GGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAAtgattgtttattgcagcttataatgg<br>ttacaaataaagcaatagcatcacaaatttcacaaataaagcatttttttcactgcattctagttgtggtttgtcc<br>aaactcatcaatgtatcttatTTCCGTTCGCACGCCGATTACCGGCGCATCACGCGCGCCAG<br>CGCGCTCCTGGACGCCTGCGGATTCTACTGGGGGCCCCTGAGCGTGCACGGGGCGC<br>ACGAGCGGCTGCGCGCCGAGCCCGTGGGCACCTTCCTGGTGCGCGACAGCCGCCAG<br>CGGAACTGCTTTTTCGCCCTTAGCGTGAAGATGGCCTCGGGACCCACGAGCATCCGC<br>GTGCACTTTCAGGCCGGCCGCTTTCACCTGGATGGCAGCCGCGAGAGCTTCGACTGC<br>CTCTTCGAGCTGCTGGAGCACTACGTGGCGGCGCCGCGCCGCATGCTGGGGGCCCC<br>GCTGCGCCAGCGCCGCGTGCGGCCGCTGCAGGAGCTGTCCGCCAGCGCATCGTG<br>GCCACCGTGGGCGCGAGAACCTGGCTCGCATCCCCCTCAACCCCGTCCTCCGCGAC<br>TACCTGAGCTCCTTC (SEQ ID NO: 288) | 2541 |
| pARBI-684:<br>SRP14_1_E<br>xogenous_6<br>4 | GGCAGACAAACAGTTAAAACAGAGGAGTGGGGTAAGTGATGACCTAACCCAGCCC<br>CGCTGCTCTAGTTTTGTTAAACACCTCATCTGCTATCACGGTCGGCGAAACCCTGGA<br>GAAACTATTATTTCCACGACGGAAACATGTAATATCGAAGCACGTTAAATTCCACTC<br>AAAGTGGCGGCGTCTGGGATCCCTGACAAAGAGCCCTGGGCTGCTTGGGGCCCATT<br>GTTACCAGAAGCAACCTAGGCGGCTCAGTGCTGGGGACTGAGCCAGCTACAATCCC<br>TACTATTTTCCGGGCCCGAAGCCCCGAATGTGCTCAGTACAGGGTGGGAAAGGTA<br>GAGGAAGGCGGCGGTCCGCGGCAGACAGACTCCGGTGGCTCCCAGACACCGGGAA<br>CCCAGGGAGCATCGCCCGGCTCCCCTCCCGCTGCTTACACTTCTTCAAGGTGATATAt<br>gacgactgtgccttctagttgccagccatctgttgtttgccctccccgtgccttccttgacccctggaaggtgcc<br>actcccactgtcctttcctaataaaatgaggaaattgcatcgcattgtctgagtaggtgtcattctattctgggg<br>gtggggtggggcaggacagcaaggggggaggattgggaagacaatagcaggcatgctgggatgcggtgggc<br>tctatggGGATCTGCGATCGCTCCGGTGCCCGTCAGTGGGCAGAGCGCACATCGCCCA<br>CAGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC | 2541 |

TABLE 5-continued

CONSTRUCTS USED FOR EVALUATION OF PREDICTED LOCI

| Construct name | Sequence | Length |
|---|---|---|
| | AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatccttatGACGCTGCCCGACGTCCGGCACTTCTG<br>GAAAAGTCTGGTCAGCTCCGTCAGGAACTGGAAAACAACAGGCCAGCCCCGTTAG<br>CCAGCCCCAAATCCTCGTCCTGCCGCGTCAAGGCCCTGGTCCTCCTGCAGGAGGCAC<br>AGGTCTCGAGTAACGCCTGAGCCGCCCCCTTCCCTCGCCGGCCAGGCCTAGCCATA<br>CCTGCTCGCTCTCCAACAACACCATCGCGGCGACGCTGGCTCGACTCCCTCCGCTTAA<br>GCCCCTAGCAGTGAGAGCCGGAAGTTCGGCCTAGGCTGGGCGGGACTTCCGCTACT<br>AGACTTCCATTGTCTTCCACCAATCTCTTCTCTTCCACCAATCCCGGCCTGCGCCCTCC<br>CCCCTCCCCGCCCGCCTAGCGCCCGCGCCCTGGGACGTCCGGGGGCCTGTGACCCG<br>GAGGCGCTGGGGCTGTCCTGGGTC (SEQ ID NO: 289) | |
| pARBI-685:<br>SRP14_2_E<br>xogenous_6<br>5_66 | GTCTGTCTGCCGCGGACCGCCGCCTTCCTCTACCTTTCCCCACCCTGTACTGAGCACA<br>TTCGGGGCTTCGGGCCCGGAAAATAGTAGGGATTGTAGCTGGCTCAGTCCCCAGCA<br>CTGAGCCGCCTAGGTTGCTTCTGGTAACAATGGGCCCCAAGCAGCCCAGGGCTCTTT<br>GTCAGGGATCCCAGACGCCGCCACTTTGAGTGGAATTTAACGTGCTTCGATATTACA<br>TGTTTCCGTCGTGGAAATAATAGTTTCTCCAGGGTTTCGCCAGACCGTGATAGCAGA<br>TGAGGTGTTTAACAAAACTAGAGCAGCGGGGCTGGGTTAGGTCATCACTTACCCCA<br>CTCCTCTGTTTTAACTGTTTGTCTGCCGCTCAGCCACGTACGCGGCCGTGTTCACCAG<br>GATGCATTTTTTCCTTCAGATGACGGTCGAACCAAACCCATTCCAAAGAAGtgacgact<br>gtgccttctagttgccagccatctgttgtttgccccctccccgtgccttccttgaccctggaaggtgccactcccac<br>tgtcctttcctaataaaatgaggaaattgcatcgcattgtctgagtaggtgtcattctattctgggggtggggtg<br>gggcaggacagcaagggggaggattgggaagacaatagcaggcatgctggggatgcggtgggctctatggG<br>GATCTGCGATCGCTCCGGTGCCCGTCAGTGGGCAGAGCGCACATCGCCCACAGTCC<br>CCGAGAAGTTGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCGCGCCATCCACGCGCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcatttttttcactgcattctagttg<br>tggtttgtccaaactcatcaatgtatccttatGGTACTGTGGAGGGCTTTGAGCCCGCAGACAAC<br>AAGTGTCTGTTAAGAGCTACCGATGGGAAGAAGATCAGCACTGTGGTGAGCTT<br>AATTTCTAAGGCTGTCTTTTGAAATGTAAAGACTTGAACTTAACAGAGGATGGGGCG<br>TTTCTGAACCAGGCTTTTATTTGTTMCCCTTTTGCCCTGTGTGGCTATTTTTGAGAC<br>CAGGACCTTCCTATACTTTAGTAGTGGAAACCTCAAGAATAAAATAAGAAGGTAGA<br>GGTCAGACAGTCGTTAGTTCTGCTAAAGCTCTTGTGGAAATGAAAGTAGCATATTGG<br>TCCTTATTCGTAGTACTGTAAGGAGCAGCTGGCATAAATATTTGATTCCTTAGCCCCT<br>TACTGTGCTGGGCCTTCAATAAGCAGTTTCTTGGTACCAGGTGATGCTATTATTTCCT<br>TATCTTTGTGGTTCAC (SEQ ID NO: 290) | 2541 |
| pARBI-686:<br>SRSF9_1_Ex<br>ogenous_6<br>7 | CCCACGTCAGTGAGTGCTCACAAGTCTGTGAGGTAGGCGGCGCCACAGAGAGAAAC<br>TGAGGCGCGGGAGCCCAAGCCACTTGTCCAGCGCCTCAGCCGAGCGCGAACCGCGC<br>TCGGGGATGGCATCCACACGGCCCGGCCCCAGGCTCTCCCTGTCAGCGCCCGAAGG<br>CCCTTCGCACCTCCAGGGGGCGCCGGCCTGCGCGCACGCGCAATGGTCGCAGCCGC<br>GTTCTCTTTAAGAGGACTCCTTTTGCCTCCGCCGACCCCTTCGCTCCGCTCCGCGTTC<br>CCACAATGCAGTGCGGCTGAGCGCCTCGGAGCCCGCGGGGACGCTGCGGGGGGAC<br>CCGTGCTGAggcggcggcggcgacgtgggctgcggcgggcccgcggcgtcggcggtgcggatgtcggg<br>ctgggcggacgagcgcggcggcgAGGGCGACGGGCGCATCTACTgacgactgtgccttctagttgcc<br>agccatctgttgtttgccccctccccgtgccttccttgaccctggaaggtgccactcccactgtcctttcctaataa<br>aatgaggaaattgcatcgcattgtctgagtaggtgtcattctattctgggggtggggtggggcaggacagcaa | 2541 |

TABLE 5-continued

CONSTRUCTS USED FOR EVALUATION OF PREDICTED LOCI

| Construct name | Sequence | Length |
|---|---|---|
| | gggggaggattgggaagacaatagcaggcatgctggggatgcggtgggctctatggGGATCTGCGATC<br>GCTCCGGTGCCCGTCAGTGGGCAGAGCGCACATCGCCCACAGTCCCCGAGAAGTTG<br>GGGGGAGGGGTCGGCAATTGAACGGGTGCCTAGAGAAGGTGGCGCGGGGTAAAC<br>TGGGAAAGTGATGTCGTGTACTGGCTCCGCCTTTTTCCCGAGGGTGGGGGAGAACC<br>GTATATAAGTGCAGTAGTCGCCGTGAACGTTCTTTTTCGCAACGGGTTTGCCGCCAG<br>AACACAGCTGAAGCTTCGAGGGGCTCGCATCTCTCCTTCACGCGCCCGCCGCCCTAC<br>CTGAGGCCGCCATCCACGCCGGTTGAGTCGCGTTCTGCCGCTCCCGCCTGTGGTGC<br>CTCCTGAACTGCGTCCGCCGTCTAGGTAAGTTTAAAGCTCAGGTCGAGACCGGGCCT<br>TTGTCCGGCGCTCCCTTGGAGCCTACCTAGACTCAGCCGGCTCTCCACGCTTTGCCTG<br>ACCCTGCTTGCTCAACTCTACGTCTTTGMCGTTTTCTGTTCTGCGCCGTTACAGATC<br>CAAGCTGTGACCGGCGCCTACTCTAGAGCTAGCGAATTgccgccaccATGGTGAGCAA<br>GGGCGAGGAGCTGTTCACCGGGGTGGTGCCCATCCTGGTCGAGCTGGACGGCGAC<br>GTAAACGGCCACAAGTTCAGCGTGTCCGGCGAGGGCGAGGGCGATGCCACCTACG<br>GCAAGCTGACCCTGAAGTTCATCTGCACCACCGGCAAGCTGCCCGTGCCCTGGCCCA<br>CCCTCGTGACCACCCTGACCTACGGCGTGCAGTGCTTCAGCCGCTACCCCGACCACA<br>TGAAGCAGCACGACTTCTTCAAGTCCGCCATGCCCGAAGGCTACGTCCAGGAGCGC<br>ACCATCTTCTTCAAGGACGACGGCAACTACAAGACCCGCGCCGAGGTGAAGTTCGA<br>GGGCGACACCCTGGTGAACCGCATCGAGCTGAAGGGCATCGACTTCAAGGAGGAC<br>GGCAACATCCTGGGGCACAAGCTGGAGTACAACTACAACAGCCACAACGTCTATAT<br>CATGGCCGACAAGCAGAAGAACGGCATCAAGGTGAACTTCAAGATCCGCCACAACA<br>TCGAGGACGGCAGCGTGCAGCTCGCCGACCACTACCAGCAGAACACCCCCATCGGC<br>GACGGCCCCGTGCTGCTGCCCGACAACCACTACCTGAGCACCCAGTCCAAGCTGAG<br>CAAAGACCCCAACGAGAAGCGCGATCACATGGTCCTGCTGGAGTTCGTGACCGCCG<br>CCGGGATCACTCTCGGCATGGACGAGCTGTACAAatgattgtttattgcagcttataatggttac<br>aaataaagcaatagcatcacaaatttcacaaataaagcattttttcactgcattctagttgtggtttgtccaaac<br>tcatcaatgtatcttatgTGGGGAACCTTCCGACCGACGTGCGCGAGAAGGACTTGGAGG<br>ACCTGTTCTACAAGTACGGCCGCATCCGCGAGATCGAGCTCAAGAACCGGCACGGC<br>CTCGTGCCCTTCGTCGTGCGCTTCGAGGACCCCCGGTGAGGccccgcgccctgccc<br>tctcctcctcggtgcctgaggccccgccttccctgctgtccctccccccagggctccctcccccccggcctccct<br>ccccccgcctccgcgcagacccctcaCGGCGCCCCCTCACGGGTGGAGGATGAGGCAGCCTC<br>TCCTCGCAGGCCCGGGCCGTCCTTCGCGCCGTCGTCACTTCCTTTATTTTTATTATTCC<br>AATATTTTACTTAGAAACCCAAAAGCTGAGCCTTTGGAGGGCCCAAGCCCGCCTGCA<br>CCGGCCTCGGGGGGTCCAAATGAGCCTTGTCCGCC (SEQ ID NO: 291) | |
| pARBI-687:<br>SRSF9_2_Ex<br>ogenous_6<br>8 | TGTGGTGTGCTTTTCGAGAAAATGCTCACGAAGATTAGAAAAACACTGATGGTTTAT<br>TGGCAAAATCAATAATCTGTCAGCAGTTGATTCtttttttttCTCTGAATTAGCCCTCTTAT<br>GAGTAATCTGTTTGCTCATTCATTATAATTTCATACCTCTAAAACTGCGTGTGACAGC<br>TGTAAAGGTTAATTCCAGTATCATGAAACGTCTCCAAACCAAAGCAGAAGTGCTTCA<br>GGATCCTGATTTGTGTGTTTTTTTCTTCACTCTAGGTTTCCCTTTTATGCTTACTACTCA<br>TGCCCCTCACTTGGAAAGTCACTTGGCCTCCTGAACAGCACTAACTCCAAACGtttttttt<br>gttgttgttgttttttttAGAGATGCAGAGGATGCTATTTATGGAAGAAATGGTTATGATTAT<br>GGCCAGTGTCGGCTTCGTGTGGAGTTCCCCAGGtgacgactgtgccttctagttgccagccatct<br>gttgtttgccctccccgtgccttccttgacctggaaggtgccactcccactgtccttcctaataaaatgagg<br>aaattgcatcgcattgtctgagtaggtgtcattctattctgggggtggggtggggcaggacagcaaggggga<br>ggattgggaagacaatagcaggcatgctggggatgcggtgggctctatggGGATCTGCGATCGCTCC<br>GGTGCCCGTCAGTGGGCAGAGCGCACATCGCCCACAGTCCCCGAGAAGTTGGGGGG<br>GAGGGGTCGGCAATTGAACGGGTGCCTAGAGAAGGTGGCGCGGGGTAAACTGGGG<br>AAAGTGATGTCGTGTACTGGCTCCGCCTTTTTCCCGAGGGTGGGGGAGAACCGTAT<br>ATAAGTGCAGTAGTCGCCGTGAACGTTCTTTTTCGCAACGGGTTTGCCGCCAGAACA<br>CAGCTGAAGCTTCGAGGGGCTCGCATCTCTCCTTCACGCGCCCGCCGCCCTACCTGA<br>GGCCGCCATCCACGCCGGTTGAGTCGCGTTCTGCCGCTCCCGCCTGTGGTGCCTCC<br>TGAACTGCGTCCGCCGTCTAGGTAAGTTTAAAGCTCAGGTCGAGACCGGGCCTTTGT<br>CCGGCGCTCCCTTGGAGCCTACCTAGACTCAGCCGGCTCTCCACGCTTTGCCTGACCC<br>TGCTTGCTCAACTCTACGTCTTTGTTTCGTTTTCTGTTCTGCGCCGTTACAGATCCAAG<br>CTGTGACCGGCGCCTACTCTAGAGCTAGCGAATTgccgccaccATGGTGAGCAAGGGC<br>GAGGAGCTGTTCACCGGGGTGGTGCCCATCCTGGTCGAGCTGGACGGCGACGTAA<br>ACGGCCACAAGTTCAGCGTGTCCGGCGAGGGCGAGGGCGATGCCACCTACGGCAA<br>GCTGACCCTGAAGTTCATCTGCACCACCGGCAAGCTGCCCGTGCCCTGGCCCACCCT<br>CGTGACCACCCTGACCTACGGCGTGCAGTGCTTCAGCCGCTACCCCGACCACATGAA<br>GCAGCACGACTTCTTCAAGTCCGCCATGCCCGAAGGCTACGTCCAGGAGCGCACCAT<br>CTTCTTCAAGGACGACGGCAACTACAAGACCCGCGCCGAGGTGAAGTTCGAGGGCG<br>ACACCCTGGTGAACCGCATCGAGCTGAAGGGCATCGACTTCAAGGAGGACGGCAAC<br>ATCCTGGGGCACAAGCTGGAGTACAACTACAACAGCCACAACGTCTATATCATGGCC<br>GACAAGCAGAAGAACGGCATCAAGGTGAACTTCAAGATCCGCCACAACATCGAGGA<br>CGGCAGCGTGCAGCTCGCCGACCACTACCAGCAGAACACCCCCATCGGCGACGGCC<br>CCGTGCTGCTGCCCGACAACCACTACCTGAGCACCCAGTCCAAGCTGAGCAAAGACC<br>CCAACGAGAAGCGCGATCACATGGTCCTGCTGGAGTTCGTGACCGCCGCCGGGATC<br>ACTCTCGGCATGGACGAGCTGTACAAatgattgtttattgcagcttataatggttacaaataaagca<br>atagcatcacaaatttcacaaataaagcattttttcactgcattctagttgtggtttgtccaaactcatcaatgta<br>tcttatACTTATGGAGGTCGGGGTGGGTGCCCCGTGGTGGAGGAATGGGCCTCCT<br>ACAAGAAGATCTGATTTCCGAGTTCTTGTTTCAGGTATGTTCCTTTCAAACAGaatgag<br>atgatacatgtaaaatacttaacacagagtctgtcttccaagaaatgatagctgttattcttCAGTGCATGG<br>GACACGGGGCTTTCTTTTCAATAGCCTGTGTGAAGCCTTGCCCTGGATTGCCAATG<br>AGGAAAGTATCCTGCAAATGAAATTGCGCTGGGAGTGCAGCCTTGGAAGAACATAA<br>CCATATTTCTTGTAAAGGAGTTTTCTAGTGGTGAGAAGGAAAGATGATGGGAAAAC | 2541 |

TABLE 5-continued

CONSTRUCTS USED FOR EVALUATION OF PREDICTED LOCI

| Construct name | Sequence | Length |
|---|---|---|
| | TTGAGCTACAATTCTAAAGATGCTTCTTTTGGAATATACTTGGCATCAGACATGGTAG<br>AAAGGCATTCAAGGAGCCAGATTTGAACAACTTACCCAGCC (SEQ ID NO: 292) | |
| pARBI-688:<br>SRSF9_3_Ex<br>ogenous_6<br>9 | GATGGCATCCACACGGCCCGGCCCCAGGCTCTCCCTGTCAGCGCCCGAAGGCCCTTC<br>GCACCTCCAGGGGGCGCCGGCCTGCGCGCACGCGCAATGGTCGCAGCCGCGTTCTC<br>TTTTAAGAGGACTCCTTTTGCCTCCGCCGACCCCTTCGCTTCCGCTCCGCGTTCCCACA<br>ATGCAGTGCGGCTGAGCGCCTCGGAGCCCGCGGGGACGCTGCGGGGGGACCCGTG<br>CTGAggcggcggcggcgacgtgggctgcggcgggcccgggcgtcgggcggtgcggatgtcgggctgggcg<br>gacgagcgcggcggcgAGGGCGACGGGCGCATCTACGTGGGGAACCTTCCGACCGACGT<br>GCGCGAGAAGGACTTGGAGGACCTGTTCTACAAGTACGGCCGCATCCGCGAGATCG<br>AGCTCAAGAACCGGCACGGCCTCGTGCCCTTCGCCTTCtgacgactgtgccttctagttgccag<br>ccatctgttgtttgccctcccccgtgccttccttgacccggaaggtgccactcccactgtcctttcctaataaaa<br>tgaggaaattgcatcgcattgtctgagtaggtgtcattctattctggggggtggggtggggcaggacagcaagg<br>gggaggattgggaagacaatagcaggcatgctggggatgcggtgggctctatggGGATCTGCGATCGC<br>TCCGGTGCCCGTCAGTGGGCAGAGCGCACATCGCCCACAGTCCCCGAGAAGTTGGG<br>GGGAGGGGTCGGCAATTGAACGGGTGCCTAGAGAAGGTGGCGCGGGGTAAACTG<br>GGAAAGTGATGTCGTGTACTGGCTCCGCCTTMCCCGAGGGTGGGGGAGAACCGT<br>ATATAAGTGCAGTAGTCGCCGTGAACGTTCTTTTTCGCAACGGGTTTGCCGCCAGAA<br>CACAGCTGAAGCTTCGAGGGGCTCGCATCTCTCCTTCACGCGCCCGCCGCCCTACCT<br>GAGGCCGCCATCCACGCCGGTTGAGTCGCGTTCTGCCGCCTCCCGCCTGTGGTGCCT<br>CCTGAACTGCGTTCCGCCGTCTAGGTAAGTTTAAAGCTCAGGTCGAGACCGGGCCTTT<br>GTCCGGCGCTCCCTTGGAGCCTACCTAGACTCAGCCGGCTCTCCACGCTTTGCCTGA<br>CCCTGCTTGCTCAACTCTACGTCTTTGMCGTTTTCTGTTCTGCGCCGTTACAGATCC<br>AAGCTGTGACCGGCGCCTACTCTAGAGCTAGCGAATTgccgccaccATGGTGAGCAAG<br>GGCGAGGAGCTGTTCACCGGGGTGGTGCCCATCCTGGTCGAGCTGGACGGCGACG<br>TAAACGGCCACAAGTTCAGCGTGTCCGGCGAGGGCGAGGGCGATGCCACCTACGG<br>CAAGCTGACCCTGAAGTTCATCTGCACCACCGGCAAGCTGCCCGTGCCCTGGCCCAC<br>CCTCGTGACCACCCTGACCTACGGCGTGCAGTGCTTCAGCCGCTACCCCGACCACAT<br>GAAGCAGCACGACTTCTTCAAGTCCGCCATGCCCGAAGGCTACGTCCAGGAGCGCA<br>CCATCTTCTTCAAGGACGACGGCAACTACAAGACCCGCGCCGAGGTGAAGTTCGAG<br>GGCGACACCCTGGTGAACCGCATCGAGCTGAAGGGCATCGACTTCAAGGAGGACG<br>GCAACATCCTGGGGCACAAGCTGGAGTACAACTACAACAGCCACAACGTCTATATCA<br>TGGCCGACAAGCAGAAGAACGGCATCAAGGTGAACTTCAAGATCCGCCACAACATC<br>GAGGACGGCAGCGTGCAGCTCGCCGACCACTACCAGCAGAACACCCCCATCGGCGA<br>CGGCCCCGTGCTGCTGCCCGACAACCACTACCTGAGCACCCAGTCCAAGCTGAGCAA<br>AGACCCCAACGAGAAGCGCGATCACATGGTCCTGCTGGAGTTCGTGACCGCCGCCG<br>GGATCACTCTCGGCATGGACGAGCTGTACAAatgattgtttattgcagcttataatgttacaaat<br>aaagcaatagcatcacaaatttcacaaataaagcattttttttcactgcattctagttgtggtttgtccaaactcat<br>caatgtatcttatGTGCGCTTCGAGGACCCCCGGTGAGGccccgcgccctgccctctcctcctcg<br>gtgcctgaggcccccgccttcctgctgtccctcccccagggctcccctcccccggcctccctccccccgcct<br>ccgcgcagacccctcaCGGCGCCCCTCACGGGTGGAGGATGGAGGCAGCCTCTCCTCGCA<br>GGCCCGGGCCGTCCTTCGCGCCGTCGTCACTTCCTTTATTTTTATTATTCCAATATTTT<br>ACTTAGAAACCCAAAAGCTGAGCCTTTGGAGGGCCCAAGCCCGCCTGCACCGGCCT<br>CGGGGGGTCCAAATGAGCCTTGTCCGCCTCCTGCCTGGGGCAGCACCGTAGGGGGA<br>AGCGGCCGCGGGGCAGCGCGGGGGTCGCCGTTCGCCCTTCCCGCTCGCCTCTCCCC<br>CGGCCCGTGCTCGCCGTGGCTGGAGAGCAAGCT (SEQ ID NO: 293) | 2541 |
| pARBI-689:<br>SUB1_1_Ex<br>ogenous_7<br>0 | GTAACTGACTAGCCTTAGTAGACTGTGGTTTCCAGGTTTATTCAGAAGTAGCAAGAT<br>CCCTCCAttttttttttCTACCAAAGAAATCGTATGTGGGATCCCAAACCACAAATAACCG<br>TTCCTGTGGTTAATACTACTATAATGCCTGAAGTGTCTTTTGGGATCCTGAGAACAGA<br>GTTTGAAAACATTACTAGACAGAAGGATTGGTTAGATTCATAGTTTTGTTGTTGAGT<br>GAAACTTGCTTATGTATATATTTATGATATTTTGGATGTAGTCTTTTGATTGTTTAAAT<br>CTTAAAAAGTAATGGGATCTTTTGACACTGGGGTATGTTTTATTTTTATGTGTGCAAA<br>TTTTAACCATATTCTTTTCTAGTTAAAGAGGAAAAAGCAAGTTGCTCCAGAAAAACCT<br>GTAAAGAAACAAAAGACAGGTGAGACTTCGAGAGCCCTGTCAtgacgactgtgccttctag<br>ttgccagccatctgttgtttgccctcccccgtgccttccttgacccggaaggtgccactcccactgtcctttcct<br>aataaaatgaggaaattgcatcgcattgtctgagtaggtgtcattctattctggggggtggggtggggcaggac<br>agcaaggggggaggattgggaagacaatagcaggcatgctggggatgcggtgggctctatggGGATCTGC<br>GATCGCTCCGGTGCCCGTCAGTGGGCAGAGCGCACATCGCCCACAGTCCCCGAGAA<br>GTTGGGGGGAGGGGTCGGCAATTGAACGGGTGCCTAGAGAAGGTGGCGCGGGGT<br>AAACTGGGAAAGTGATGTCGTGTACTGGCTCCGCCTTTTTCCCGAGGGTGGGGGAG<br>AACCGTATATAAGTGCAGTAGTCGCCGTGAACGTTCTTTTTCGCAACGGGTTTGCCG<br>CCAGAACACAGCTGAAGCTTCGAGGGGCTCGCATCTCTCCTTCACGCGCCCGCCGCC<br>CTACCTGAGGCCGCCATCCACGCCGGTTGAGTCGCGTTCTGCCGCCTCCCGCCTGTG<br>GTGCCTCCTGAACTGCGTTCCGCCGTCTAGGTAAGTTTAAAGCTCAGGTCGAGACCGG<br>GCCTTTGTCCGGCGCTCCCTTGGAGCCTACCTAGACTCAGCCGGCTCTCCACGCMG<br>CCTGACCCTGCTTGCTCAACTCTACGTCTTTGTTTCGTTTTCTGTTCTGCGCCGTTACA<br>GATCCAAGCTGTGACCGGCGCCTACTCTAGAGCTAGCGAATTgccgccaccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA | 2541 |

TABLE 5-continued

CONSTRUCTS USED FOR EVALUATION OF PREDICTED LOCI

| Construct name | Sequence | Length |
|---|---|---|
| | GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatTCTTCTAAACAGAGCAGCAGCAGCAGAGATGATAACATGTT<br>TCAGGTAAAGTTGGCTAttttttttttttttttttttgacatggagtcatgctctgtcacccaggctggagtg<br>cagtggcgccatctcggctcactgcaacctcagcctcctgagttcaagcagttctctgcctcagcctcccgagta<br>gctaggattacaggcatccgccaccagacctggctaattttttgtatttttagtagagatgggtttcaccatcttg<br>gccaggctggtcttgaactcctgacccttgtgatccaactgcctcagcctccaaaagtgctgggtttacaggtgtg<br>agccaccatgccttgccAAAGTTGGCTGTTTCTTTAGATTCAGAGGAATTATTATCTGGCTT<br>GATCTGAAGAATGTTAAAAGTACTATGATCTGATAATTGCCTAATATG (SEQ ID NO: 294) | |
| pARBI-690:<br>SUB1_2_Ex<br>ogenous_7<br>1 | ATAAATAAACATATCCTGGAAATGGAATAAGTTGGTTATATTCTTTTTAATTAGTATA<br>TCTGCTTCGTAAAATAAGTAACTGACTAGCCTTAGTAGACTGTGGTTTCCAGGTTTAT<br>TCAGAAGTAGCAAGATCCCTCCATTTTTTTTCTACCAAAGAAATCGTATGTGGGATC<br>CCAAACCACAAAATAACCGTTCCTGTGGTTAATACTACTATAATGCCTGAAGTGTCTT<br>TTGGGATCCTGAGAACAGAGTTTGAAAACATTACTAGACAGAAGGATTGGTTAGAT<br>TCATAGTTTTGTTGTTGAGTGAAACTTGCTTATGTATATATTTATGATATTTTGGATGT<br>AGTCTTTTGATTGTTTAAATCTTAAAAAGTAATGGGATCTTTTGACACTGGGGTATGT<br>TTTATTTTTATGTGTGCAAATTTTAACCATATTCTTTTCTAGTTAtgacgactgtgccttctag<br>ttgccagccatctgttgtttgcccctccccccgtgcctccttgaccctggaaggtgccactcccactgtcctttcct<br>aataaaatgaggaaattgcatcgcattgtctgagtaggtgtcattctattctgggggtggggtgggcaggac<br>agcaaggggaggattgggaagacaatagcaggcatgctgggatgcggtgggctctatggGGATCTGC<br>GATCGCTCCGGTGCCCGTCAGTGGGCAGAGCGCACATCGCCCACAGTCCCCGAGAA<br>GTTGGGGGAGGGGTCGGCAATTGAACGGGTGCCTAGAGAAGGTGGCGCGGGGT<br>AAACTGGGAAAGTGATGTCGTGTACTGGCTCCGCCTTTTTTCCCGAGGGTGGGGGAG<br>AACCGTATATAAGTGCAGTAGTCGCCGTGAACGTTCTTTTTCGCAACGGGTTTGCCG<br>CCAGAACACAGCTGAAGCTTCGAGGGGCTCGCATCTCTCCTTCACGCGCCCGCCGCC<br>CTACCTGAGGCCGCCATCCACGCCGGTTGAGTCGCGTTCTGCCGCCTCCCGCCTGTG<br>GTGCCTCCTGAACTGCGTCCGCCGTCTAGGTAAGTTTAAAGCTCAGGTCGAGACCGG<br>GCCTTTGTCCGGCGCTCCCTTGGAGCCTACCTAGACTCAGCCGGCTCTCCACGCMG<br>CCTGACCCTGCTTGCTCAACTCTACGTCTTTGTTTCGTTTTCTGTTCTGCGCCGTTACA<br>GATCCAAGCTGTGACCGGCGCCTACTCTAGAGCTAGCGAATTgccgccaccATGGTGA<br>GCAAGGGCGAGGAGCTGTTCACCGGGGTGGTGCCCATCCTGGTCGAGCTGGACGG<br>CGACGTAAACGGCCACAAGTTCAGCGTGTCCGGCGAGGGCGAGGGCGATGCCACC<br>TACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGAC<br>CACATGAAGCAGCACGACTTCTTCAAGTCCGCCATGCCCGAAGGCTACGTCCAGGA<br>GCGCACCATCTTCTTCAAGGACGACGGCAACTACAAGACCCGCGCCGAGGTGAAGT<br>TCGAGGGCGACACCCTGGTGAACCGCATCGAGCTGAAGGGCATCGACTTCAAGGA<br>GGACGGCAACATCCTGGGGCACAAGCTGGAGTACAACTACAACAGCCACAACGTCT<br>ATATCATGGCCGACAAGCAGAAGAACGGCATCAAGGTGAACTTCAAGATCCGCCAC<br>AACATCGAGGACGGCAGCGTGCAGCTCGCCGACCACTACCAGCAGAACACCCCCAT<br>CGGCGACGGCCCCGTGCTGCTGCCCGACAACCACTACCTGAGCACCCAGTCCAAGCT<br>GAGCAAAGACCCCAACGAGAAGCGCGATCACATGGTCCTGCTGGAGTTCGTGACCG<br>CCGCCGGGATCACTCTCGGCATGGACGAGCTGTACAAatgattgtttattgcagcttataatgg<br>ttacaaataaagcaatagcatcacaaatttcacaaataaagcatttttttcactgcattctagttgtggtttgtcc<br>aaactcatcaatgtatcttatAAGAGGAAAAAGCAAGTTGCTCCAGAAAAACCTGTAAAGA<br>AACAAAAGACAGGTGAGACTTCGAGAGCCCTGTCATCTTCTAAACAGAGCAGCAGC<br>AGCAGAGATGATAACATGTTTCAGGTAAAGTTGGCTATTTTTTTTTTTTTTTTTTGA<br>CATGGAGTCATGCTCTGTCACCCAGGCTGGAGTGCAGTGGCGCCATCTCGGCTCACT<br>GCAACCTCAGCCTCCTGAGTTCAAGCAGTTCTCTGCCTCAGCCTCCCGAGTAGCTAG<br>GATTACAGGCATCCGCCACCAGACCTGGCTAATTTTTGTATTTTTAGTAGAGATGGG<br>GTTTCACCATCTTGGCCAGGCTGGTCTTGAACTCCTGACCTTGTGATCCAACTGCCTC<br>AGCCTCCAAAAGTGCTGGGTTTACAGGTGTGAGCCACCATGCCTTGCCAAAGTTGGC<br>TGTTTCTTT (SEQ ID NO: 295) | 2541 |
| pARBI-691:<br>SUB1_3_Ex<br>ogenous_7<br>2 | AATTAGTATATCTGCTTCGTAAAATAAGTAACTGACTAGCCTTAGTAGACTGTGGTTT<br>CCAGGTTTATTCAGAAGTAGCAAGATCCCTCCATTTTTTTTCTACCAAAGAAATCGT<br>ATGTGGGATCCCAAACCACAAAATAACCGTTCCTGTGGTTAATACTACTATAATGCCT<br>GAAGTGTCTTTTGGGATCCTGAGAACAGAGTTTGAAAACATTACTAGACAGAAGGA<br>TTGGTTAGATTCATAGTTTTGTTGTTGAGTGAAACTTGCTTATGTATATATTTATGAT<br>ATTTTGGATGTAGTCTTTTGATTGTTTAAATCTTAAAAAGTAATGGGATCTTTTGACA<br>CTGGGGTATGTTTTATTTTTATGTGTGCAAATTTTAACCATATTCTTTTCTAGTTAAAG<br>AGGAAAAAGCAAGTTGCTCCAGAAAAACCTGTAAAGAAACAAAAGtgacgactgtgccttt<br>ctagttgccagccatctgttgtttgcccctccccccgtgcctccttgaccctggaaggtgccactcccactgtcctt<br>tcctaataaaatgaggaaattgcatcgcattgtctgagtaggtgtcattctattctgggggtggggtgggcagga<br>cagcaaggggaggattgggaagacaatagcaggcatgctgggatgcggtgggctctatggGGATC<br>TGCGATCGCTCCGGTGCCCGTCAGTGGGCAGAGCGCACATCGCCCACAGTCCCCGA<br>GAAGTTGGGGGAGGGGTCGGCAATTGAACGGGTGCCTAGAGAAGGTGGCGCGG<br>GGTAAACTGGGAAAGTGATGTCGTGTACTGGCTCCGCCTTTTTTCCCGAGGGTGGGG | 2541 |

TABLE 5-continued

CONSTRUCTS USED FOR EVALUATION OF PREDICTED LOCI

| Construct name | Sequence | Length |
|---|---|---|
| | GAGAACCGTATATAAGTGCAGTAGTCGCCGTGAACGTTCTTTTTCGCAACGGGTTTG<br>CCGCCAGAACACAGCTGAAGCTTCGAGGGGCTCGCATCTCTCCTTCACGCGCCCGCC<br>GCCCTACCTGAGGCCGCCATCCACGCCGGTTGAGTCGCGTTCTGCCGCCTCCCGCCT<br>GTGGTGCCTCCTGAACTGCGTCCGCCGTCTAGGTAAGTTTAAAGCTCAGGTCGAGAC<br>CGGGCCTTTGTCCGGCGCTCCCTTGGAGCCTACCTAGACTCAGCCGGCTCTCCACGC<br>TTTGCCTGACCCTGCTTGCTCAACTCTACGTCTTTGTTTCGTTTTCTGTTCTGCGCCGT<br>TACAGATCCAAGCTGTGACCGGCGCCTACTCTAGAGCTAGCGAATTgccgccaccATGG<br>TGAGCAAGGGCGAGGAGCTGTTCACCGGGGTGGTGCCCATCCTGGTCGAGCTGGA<br>CGGCGACGTAAACGGCCACAAGTTCAGCGTGTCCGGCGAGGGCGAGGGCGATGCC<br>ACCTACGGCAAGCTGACCCTGAAGTTCATCTGCACCACCGGCAAGCTGCCCGTGCCC<br>TGGCCCACCCTCGTGACCACCCTGACCTACGGCGTGCAGTGCTTCAGCCGCTACCCC<br>GACCACATGAAGCAGCACGACTTCTTCAAGTCCGCCATGCCCGAAGGCTACGTCCAG<br>GAGCGCACCATCTTCTTCAAGGACGACGGCAACTACAAGACCCGCGCCGAGGTGAA<br>GTTCGAGGGCGACACCCTGGTGAACCGCATCGAGCTGAAGGGCATCGACTTCAAGG<br>AGGACGGCAACATCCTGGGGCACAAGCTGGAGTACAACTACAACAGCCACAACGTC<br>TATATCATGGCCGACAAGCAGAAGAACGGCATCAAGGTGAACTTCAAGATCCGCCA<br>CAACATCGAGGACGGCAGCGTGCAGCTCGCCGACCACTACCAGCAGAACACCCCCA<br>TCGGCGACGGCCCCGTGCTGCTGCCCGACAACCACTACCTGAGCACCCAGTCCAAGC<br>TGAGCAAAGACCCCAACGAGAAGCGCGATCACATGGTCCTGCTGGAGTTCGTGACC<br>GCCGCCGGGATCACTCTCGGCATGGACGAGCTGTACAatgattgtttattgcagcttataat<br>ggttacaaataaagcaatagcatcacaaatttcacaaataaagcatttttttcactgcattctagttgtggtttgt<br>ccaaactcatcaatgtatcttatACAGGTGAGACTTCGAGAGCCCTGTCATCTTCTAAACAGA<br>GCAGCAGCAGCAGAGATGATAACATGTTTCAGGTAAAGTTGGCTATTTTTTTTTTTT<br>TTTTTTTGACATGGAGTCATGCTCTGTCACCCAGGCTGGAGTGCAGTGGCGCCATCT<br>CGGCTCACTGCAACCTCAGCCTCCTGAGTTCAAGCAGTTCTCTGCCTCAGCCTCCCGA<br>GTAGCTAGGATTACAGGCATCCGCCACCAGACCTGGCTAATTTTTGTATTTTTAGTAG<br>AGATGGGGTTTCACCATCTTGGCCAGGCTGGTCTTGAACTCCTGACCTTGTGATCCA<br>ACTGCCTCAGCCTCCAAAAGTGCTGGGTTTACAGGTGTGAGCCACCATGCCTTGCCA<br>AAGTTGGCTGTTTCTTTAGATTCAGAGGAATTATTATCTGGCTTGATCTGAAGAATGT<br>TAAAAGT (SEQ ID NO: 296) | |
| pARBI-692:<br>TET2_1_Exo<br>genous_73 | CACATTTTAATTTTTGTTTCCATGCTCTTTAGAATTCAACTAGAGGGCAGCCTTGTGG<br>ATGGCCCCGAAGCAAGCCTGATGGAACAGGATAGAACCAACCATGTTGAGGGCAAC<br>AGACTAAGTCCATTCCTGATACCATCACCTCCCATTTGCCAGACAGAACCTCTGGCTA<br>CAAAGCTCCAGAATGGAAGCCCACTGCCTGAGAGAGCTCATCCAGAAGTAAATGGA<br>GACACCAAGTGGCACTCTTTCAAAAGTTATTATGGAATACCCTGTATGAAGGGAAGC<br>CAGAATAGTCGTGTGAGTCCTGACTTTACACAAGAAAGTAGAGGGTATTCCAAGTG<br>TTTGCAAAATGGAGGAATAAAACGCACAGTTAGTGAACCTTCTCTCTCTGGGCTCCT<br>TCAGATCAAGAAATTGAAACAAGACCAAAAGGCTAATGGAGAAAGACGTAACtgacg<br>actgtgccttctagttgccagccatctgttgtttgccctcccccgtgccttccttgaccctggaaggtgccactcc<br>cactgtcctttcctaataaaatgaggaaattgcatcgcattgtctgagtaggtgtcattctattctgggggtggg<br>gtggggcaggacagcaagggggaggattgggaagacaatagcaggcatgctggggatgcggtgggctctat<br>ggGGATCTGCGATCGCTCCGGTGCCCGTCAGTGGGCAGAGCGCACATCGCCCACAG<br>TCCCCGAGAAGTTGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAatgattgtttattgc<br>agcttataatggttacaaataaagcaatagcatcacaaatttcacaaataaagcatttttttcactgcattctag<br>ttgtggtttgtccaaactcatcaatgtatcttatTTCGGGGTAAGCCAAGAAAGAAATCCAGGTG<br>AAAGCAGTCAACCAAATGTCTCCGATTTGAGTGATAAGAAAGAATCTGTGAGTCTG<br>TAGCCCAAGAAAATGCAGTTAAAGATTTCACCAGTTTTTCAACACATAACTGCAGTG<br>GGCCTGAAAATCCAGAGCTTCAGATTCTGAATGAGCAGGAGGGGAAAAGTGCTAAT<br>TACCATGACAAGAACATTGTATTACTTAAAAACAAGGCAGTGCTAATGCCTAATGGT<br>GCTACAGTTTCTGCCTCTTCCGTGGAACACACACATGGTGAACTCCTGGAAAAAACA<br>CTGTCTCAATATTATCCAGATTGTGTTTCCATTGCGGTGCAGAAAACCACATCTCACA<br>TAAATGCCATTAACAGTCAGGCTACTAATGAGTTGTCCTGTGAGATCACTCACCCATC<br>GCATACCTCAGGGCAGATC (SEQ ID NO: 297) | 2541 |

TABLE 5-continued

CONSTRUCTS USED FOR EVALUATION OF PREDICTED LOCI

| Construct name | Sequence | Length |
|---|---|---|
| pARBI-693: TET2_2_Exo genous_74 | AATGGAGAAAGACGTAACTTCGGGGTAAGCCAAGAAAGAAATCCAGGTGAAAGCA<br>GTCAACCAAATGTCTCCGATTTGAGTGATAAGAAAGAATCTGTGAGTTCTGTAGCCC<br>AAGAAAATGCAGTTAAAGATTTTCACCAGTTTTTCAACACATAACTGCAGTGGGCCTG<br>AAAATCCAGAGCTTCAGATTCTGAATGAGCAGGAGGGGAAAAGTGCTAATTACCAT<br>GACAAGAACATTGTATTACTTAAAAACAAGGCAGTGCTAATGCCTAATGGTGCTACA<br>GTTTCTGCCTCTTCCGTGGAACACACATGGTGAACTCCTGGAAAAAACACTGTCT<br>CAATATTATCCAGATTGTGTTTCCATTGCGGTGCAGAAAACCACATCTCACATAAATG<br>CCATTAACAGTCAGGCTACTAATGAGTTGTCCTGTGAGATCACTCACCCATCGtgacga<br>ctgtgccttctagttgccagccatctgttgtttgcccctccccgtgccttccttgacctggaaggtgccactccc<br>actgtcctttcctaataaaatgaggaaattgcatcgcattgtctgagtaggtgtcattctattctgggggtgggg<br>tggggcaggacagcaaggggaggattgggaagacaatagcaggcatgctggggatgcggtgggctctatg<br>gGGATCTGCGATCGCTCCGGTGCCCGTCAGTGGGCAGAGCGCACATCGCCCACAGT<br>CCCCGAGAAGTTGGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcatttttttcactgcattctag<br>ttgtggtttgtccaaactcatcaatgtatcttatCATACCTCAGGGCAGATCAATTCCGCACAGAC<br>CTCTAACTCTGAGCTGCCTCCAAAGCCAGCTGCAGTGGTGAGTGAGGCCTGTGATGC<br>TGATGATGCTGATAATGCCAGTAAACTAGCTGCAATGCTAAATACCTGTTCCTTTCAG<br>AAACCAGAACAACTACAACAACAAAAATCAGTTTTTGAGATATGCCCATCTCCTGCA<br>GAAAATAACATCCAGGGAACCACAAAGCTAGCGTCTGGTGAAGAATTCTGTTCAGG<br>TTCCAGCAGCAATTTGCAAGCTCCTGGTGGCAGCTCTGAACGGTATTTAAAACAAAA<br>TGAAATGAATGGTGCTTACTTCAAGCAAAGCTCAGTGTTCACTAAGGATTCCTTTTCT<br>GCCACTACCACACCACCACCACCATCACAATTGCTTCTTTCTCCCCCTCCTCCTCTTCC<br>ACAGGTTCCTCAGCTT (SEQ ID NO: 298) | 2541 |
| pARB1-694: TET2_3_Exo genous_75 | GGAAAAAGCACTCTGAATGGTGGAGTTTTAGAAGAACACCACCACTACCCCAACCA<br>AAGTAACACAACACTTTTAAGGGAAGTGAAAATAGAGGGTAAACCTGAGGCACCAC<br>CTTCCCAGAGTCCTAATCCATCTACACATGTATGCAGCCCTTCTTCCGATGCTTTCTGA<br>AAGGCCTCAGAATAATTGTGTGAACAGGAATGACATACAGACTGCAGGGACAATGA<br>CTGTTCCATTGTGTTCTGAGAAAACAAGACCAATGTCAGAACACCTCAAGCATAACC<br>CACCAATTTTTGGTAGCAGTGGAGAGCTACAGGACAACTGCCAGCAGTTGATGAGA<br>AACAAAGACAAGAGATTCTGAAGGGTCGAGCAAGGAGCAAACACGAGATTCTTG<br>TGCCCCCAACACAGCACTATCTGAAACCAGGATGGATTGAATTGAAGGCCCCTCGTt<br>gacgactgtgccttctagttgccagccatctgttgtttgcccctccccgtgccttccttgacctggaaggtgcc<br>actcccactgtcctttcctaataaaatgaggaaattgcatcgcattgtctgagtaggtgtcattctattctggggg<br>gtggggtgggcaggacagcaaggggaggattgggaagacaatagcaggcatgctggggatgcggtgggc<br>tctatggGGATCTGCGATCGCTCCGGTGCCCGTCAGTGGGCAGAGCGCACATCGCCCA<br>CAGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCGG<br>CTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA | 2541 |

TABLE 5-continued

CONSTRUCTS USED FOR EVALUATION OF PREDICTED LOCI

| Construct name | Sequence | Length |
|---|---|---|
| | CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatcttatTTTCACCAAGCGGAATCCCATCTAAAA<br>CGTAATGAGGCATCACTGCCATCAATTCTTCAGTATCAACCCAATCTCTCCAATCAAA<br>TGACCTCCAAACAATACACTGGAAATTCCAACATGCCTGGGGGGCTCCCAAGGCAA<br>GCTTACACCCAGAAAACAACACAGCTGGAGCACAAGTCACAAATGTACCAAGTTGA<br>AATGAATCAAGGGCAGTCCCAAGGTACAGTGGACCAACATCTCCAGTTCCAAAAAC<br>CCTCACACCAGGTGCACTTCTCCAAAACAGACCATTTACCAAAAGCTCATGTGCAGTC<br>ACTGTGTGGCACTAGATTTCATTTTCAACAAAGAGCAGATTCCCAAACTGAAAAACT<br>TATGTCCCCAGTGTTGAAACAGCACTTGAATCAACAGGCTTCAGAGACTGAGCCATT<br>TTCAAACTCACACCTTTTGCAACAT (SEQ ID NO: 299) | |
| pARBI-695:<br>TIGIT_1_Ex<br>ogenous_76 | AAAGGGAGGTTGAGATGGGCTGAGGTCTTCTAGGAGGCGGGGAGGGAGTGCAGC<br>CTTGACAAGCCTCCCTGTGGGCGAGGTGTAAAGAGGGGCAGAAGTCAGCTCTGGA<br>AGCATAGGGCAGTGGGTGGGGAGGAGATGGGCTGGGCTGGGCTGGAGTAGAGAT<br>GTGTGGAGAAGGGTGAGAAGACTGGAAAAGACAACCTGAATGGGGGACTGGGAGC<br>CTTGAATAACAGGCATGGAGAGGAGCGTCTCTTGAAATGGAAGAAACAGGAAATA<br>ATTACAGCCTCTATGGAGGAGCAACAGGATGGACTGGAGAAACTATCATTCCAAAA<br>TCCAGTTGGGGCCTCAAAGGCCCTTAGAATTTTTCTAGGAAGGTTGAAGGCCAGCTG<br>CTGACCCAGGACTCACATGTGCTTCGTCCTCTTCCCTAGGAATGATGACAGGCACAA<br>TAGAAACAtgacgactgtgccttctagttgccagccatctgttgtttgccctcccccgtgccttccttgaccct<br>ggaaggtgccactcccactgtcctttcctaataaaatgaggaaattgcatcgcattgtctgagtaggtgtcattc<br>tattctgggggtgggtggggcaggacagcaaggggaggattgggaagacaatagcaggcatgctgggg<br>atgcggtgggctctatggGGATCTGCGATCGCTCCGGTGCCCGTCAGTGGGCAGAGCGCA<br>CATCGCCCACAGTCCCCGAGAAGTTGGGGGGAGGGGTCGGCAATTGAACGGGTGC<br>CTAGAGAAGGTGGCGCGGGGTAAACTGGGAAAGTGATGTCGTGTACTGGCTCCGC<br>CTTTTTCCCGAGGGTGGGGGAGAACCGTATATAAGTGCAGTAGTCGCCGTGAACGT<br>TCTTTTTCGCAACGGGTTTGCCGCCAGAACACAGCTGAAGCTTCGAGGGGCTCGCAT<br>CTCTCCTTCACGCGCCCGCCGCCCTACCTGAGGCGCCATCCACGCGCGGTTGAGTCG<br>CGTTCTGCCGCCTCCCGCCTGTGGTGCCTCCTGAACTGCGTCCGCCGTCTAGGTAAG<br>TTTAAAGCTCAGGTCGAGACCGGGCCTTTGTCCGGCGCTCCCTTGGAGCCTACCTAG<br>ACTCAGCCGGCTCTCCACGCTTTGCCTGACCCTGCTTGCTCAACTCTACGTCTTTGTTT<br>CGTTTTCTGTTCTGCGCCGTTACAGATCCAAGCTGTGACCGGCGCCTACTCTAGAGCT<br>AGCGAATTgccgccaccATGGTGAGCAAGGGCGAGGAGCTGTTCACCGGGGTGGTGC<br>CCATCCTGGTCGAGCTGGACGGCGACGTAAACGGCCACAAGTTCAGCGTGTCCGGC<br>GAGGGCGAGGGCGATGCCACCTACGGCAAGCTGACCCTGAAGTTCATCTGCACCAC<br>CGGCAAGCTGCCCGTGCCCTGGCCCACCCTCGTGACCACCCTGACCTACGGCGTGCA<br>GTGCTTCAGCCGCTACCCCGACCACATGAAGCAGCACGACTTCTTCAAGTCCGCCAT<br>GCCCGAAGGCTACGTCCAGGAGCGCACCATCTTCTTCAAGGACGACGGCAACTACA<br>AGACCCGCGCCGAGGTGAAGTTCGAGGGCGACACCCTGGTGAACCGCATCGAGCT<br>GAAGGGCATCGACTTCAAGGAGGACGGCAACATCCTGGGGCACAAGCTGGAGTAC<br>AACTACAACAGCCACAACGTCTATATCATGGCCGACAAGCAGAAGAACGGCATCAA<br>GGTGAACTTCAAGATCCGCCACAACATCGAGGACGGCAGCGTGCAGCTCGCCGACC<br>ACTACCAGCAGAACACCCCCATCGGCGACGGCCCCGTGCTGCTGCCCGACAACCACT<br>ACCTGAGCACCCAGTCCAAGCTGAGCAAAGACCCCAACGAGAAGCGCGATCACATG<br>GTCCTGCTGGAGTTCGTGACCGCCGCCGGGATCACTCTCGGCATGGACGAGCTGTA<br>CAAatgattgtttattgcagcttataatggttacaaataaagcaatagcatcacaaatttcacaaataaagcat<br>ttttttcactgcattctagttgtggtttgtccaaactcatcaatgtatcttatACGGGGAACATTTCTGCAG<br>AGAAAGGTGGCTCTATCATCTTACAATGTCACCTCTCCTCCACCACGGCACAAGTGA<br>CCCAGGTCAACTGGGAGCAGCAGGACCAGCTTCTGGCCATTTGTAATGCTGACTTG<br>GGGTGGCACATCTCCCCATCCTTCAAGGATCGAGTGGCCCCAGGTCCCGGCCTGGG<br>CCTCACCCTCCAGTCGCTGACCGTGAACGATACAGGGGAGTACTTCTGCATCTATCA<br>CACCTACCCTGATGGGACGTACACTGGGAGAATCTTCCTGGAGGTCCTAGAAAGCTC<br>AGGTATTCCTGCTGGAGCAAGTTGGTGGATAAACCTCTCCCTCTAGCATAGAAAATG<br>CAATCCTGAAACACTGCACAGCAGGGCTTCTCAATTCGGGATCACATTTGAATCACC<br>TGAGGAGATTTTAAATCATACTGATGCCGAGGCC (SEQ ID NO: 300) | 2541 |
| pARBI-696:<br>TIGIT_2_Ex<br>ogenous_77 | GAGGAGATGGGCTGGGCTGGGCTGGAGTAGAGATGTGTGGAGAAGGGTGAGAAG<br>ACTGGAAAAGACAACCTGAATGGGGGACTGGGAGCCTTGAATAACAGGCATGGAGA<br>GGAGCGTCTCTTGAAATGGAAGAAACAGGAAATAATTACAGCCTCTATGGAGGAGC<br>AACAGGATGGACTGGAGAAACTATCATTCCAAAATCCAGTTGGGGCCTCAAAGGCC<br>CTTAGAATTTTTCTAGGAAGGTTGAAGGCCAGCTGCTGACCCAGGACTCACATGTGC<br>TTCGTCCTCTTCCCTAGGAATGATGACAGGCACAATAGAAACAACGGGGAACATTTC<br>TGCAGAGAAAGGTGGCTCTATCATCTTACAATGTCACCTCTCCTCCACCACGGCACA<br>AGTGACCCAGGTCAACTGGGAGCAGCAGGACCAGCTTCTGGCCATTTGTAATGCTG<br>ACtgacgactgtgccttctagttgccagccatctgttgtttgccctcccccgtgccttccttgaccctggaaggt<br>gccactcccactgtcctttcctaataaaatgaggaaattgcatcgcattgtctgagtaggtgtcattctattctgg<br>gggtgggtggggcaggacagcaaggggaggattgggaagacaatagcaggcatgctggggatgcggtg<br>ggctctatggGGATCTGCGATCGCTCCGGTGCCCGTCAGTGGGCAGAGCGCACATCGCC<br>CACAGTCCCCGAGAAGTTGGGGGGAGGGGTCGGCAATTGAACGGGTGCCTAGAGA<br>AGGTGGCGCGGGGTAAACTGGGAAAGTGATGTCGTGTACTGGCTCCGCCTTTTTCC | 2541 |

TABLE 5-continued

CONSTRUCTS USED FOR EVALUATION OF PREDICTED LOCI

| Construct name | Sequence | Length |
|---|---|---|
| | CGAGGGTGGGGGAGAACCGTATATAAGTGCAGTAGTCGCCGTGAACGTTCTTTTTC<br>GCAACGGGTTTGCCGCCAGAACACAGCTGAAGCTTCGAGGGGCTCGCATCTCTCCTT<br>CACGCGCCCGCCGCCCTACCTGAGGCCGCCATCCACGCCGGTTGAGTCGCGTTCTGC<br>CGCCTCCCGCCTGTGGTGCCTCCTGAACTGCGTCCGCCGTCTAGGTAAGTTTAAAGC<br>TCAGGTCGAGACCGGGCCTTTGTCCGGCGCTCCCTTGGAGCCTACCTAGACTCAGCC<br>GGCTCTCCACGCTTTGCCTGACCCTGCTTGCTCAACTCTACGTCTTTGTTTCGTTTTCT<br>GTTCTGCGCCGTTACAGATCCAAGCTGTGACCGGCGCCTACTCTAGAGCTAGCGAAT<br>TgccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAatgattg<br>tttattgcagcttataatggttacaaataaagcaatagcatcacaaatttcacaaataaagcattttttttcactgc<br>attctagttgtggtttgtccaaactcatcaatgtatcttatTTGGGGTGGCACATCTCCCCATCCTTCA<br>AGGATCGAGTGGCCCCAGGTCCCGGCCTGGGCCTCACCCTCCAGTCGCTGACCGTG<br>AACGATCAGGGGAGTACTTCTGCATCTATCACACCTACCCTGATGGGACGTACACT<br>GGGAGAATCTTCCTGGAGGTCCTAGAAAGCTCAGGTATTCCTGCTGGAGCAAGTTG<br>GTGGATAAACCTCTCCCTCTAGCATAGAAAATGCAATCCTGAAACACTGCACAGCAG<br>GGCTTCTCAATTCGGGATCACATTTGAATCACCTGAGGAGATTTTAAATCATACTGAT<br>GCCGAGGCCTCACCCAGACCAATTCAATCAGAATCCCTAATAGCAGAGCTAAACAAG<br>GGTAAGGTCTAAAAGCATTTCCAGGTGATTCTAATGGGCAGCCAATACTGAGAACC<br>ACTGTTCTTATGTAAGAAGCACATC (SEQ ID NO: 301) | |
| pARBI-697:<br>TIGIT_3_Ex<br>ogenous_7<br>8 | CCTCCCTGTGGGCGAGGTGTAAAGAGGGGCAGAAGTCAGCTCTGGAAGCATAGGG<br>CAGTGGGTGGGGAGGAGATGGGCTGGGCTGGGCTGGAGTAGAGATGTGTGGAGA<br>AGGGTGAGAAGACTGGAAAGACAACCTGAATGGGGGACTGGGAGCCTTGAATAAC<br>AGGCATGGAGAGGAGCGTCTCTTGAAATGGAAGAAACAGGAAATAATTACAGCCTC<br>TATGGAGGAGCAACAGGATGGACTGGAGAAACTATCATTCCAAAATCCAGTTGGGG<br>CCTCAAAGGCCCTTAGAATTTTTCTAGGAAGGTTGAAGGCCAGCTGCTGACCCAGGA<br>CTCACATGTGCTTCGTCCTCTTCCCTAGGAATGATGACAGGCACAATAGAAACAACG<br>GGGAACATTTCTGCAGAGAAAGGTGGCTCTATCATCTTACAATGTCACCTCTCCTCCA<br>CCtgacgactgtgccttctagttgccagccatctgttgtttgccctccccgtgccttcttgaccctggaaggt<br>gccactcgtcctttcctaataaaatgaggaaattgcatcgcattgtctgagtaggtgtcattctattctggn<br>ggggtggggtggggcaggacagcaaggggggaggattgggaagacaatagcaggcatgctgggggatgcggtg<br>ggctctatggGGATCTGCGATCGCTCCGGTGCCCGTCAGTGGGCAGAGCGCACATCGCC<br>CACAGTCCCCGAGAAGTTGGGGGAGGGGTCGGCAATTGAACGGGTGCCTAGAGA<br>AGGTGGCGCGGGGTAAACTGGGAAAGTGATGTCGTGTACTGGCTCCGCCTTTTTCC<br>CGAGGGTGGGGGAGAACCGTATATAAGTGCAGTAGTCGCCGTGAACGTTCTTTTTC<br>GCAACGGGTTTGCCGCCAGAACACAGCTGAAGCTTCGAGGGGCTCGCATCTCTCCTT<br>CACGCGCCCGCCGCCCTACCTGAGGCCGCCATCCACGCCGGTTGAGTCGCGTTCTGC<br>CGCCTCCCGCCTGTGGTGCCTCCTGAACTGCGTCCGCCGTCTAGGTAAGTTTAAAGC<br>TCAGGTCGAGACCGGGCCTTTGTCCGGCGCTCCCTTGGAGCCTACCTAGACTCAGCC<br>GGCTCTCCACGCTTTGCCTGACCCTGCTTGCTCAACTCTACGTCTTTGTTTCGTTTTCT<br>GTTCTGCGCCGTTACAGATCCAAGCTGTGACCGGCGCCTACTCTAGAGCTAGCGAAT<br>TgccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGGCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAatgattg<br>tttattgcagcttataatggttacaaataaagcaatagcatcacaaatttcacaaataaagcattttttttcactgc<br>attctagttgtggtttgtccaaactcatcaatgtatcttatACGACAAGTGACCCAGGTCAACTG<br>GGAGCAGCAGGACCAGCTTCTGGCCATTTGTAATGCTGACTTGGGGTGGCACATCT<br>CCCCATCCTTCAAGGATCGAGTGGCCCCAGGTCCCGGCCTGGGCCTCACCCTCCAGT<br>CGCTGACCGTGAACGATCAGGGGAGTACTTCTGCATCTATCACACCTACCCTGATG<br>GGACGTACACTGGGAGAATCTTCCTGGAGGTCCTAGAAAGCTCAGGTATTCCTGCT<br>GGAGCAAGTTGGTGGATAAACCTCTCCCTCTAGCATAGAAAATGCAATCCTGAAACA<br>CTGCACAGCAGGGCTTCTCAATTCGGGATCACATTTGAATCACCTGAGGAGATTTTA<br>AATCATACTGATGCCGAGGCCTCACCCAGACCAATTCAATCAGAATCCCTAATAGCA<br>GAGCTAAACAAGGGTAAGGTCTAAAAG (SEQ ID NO: 302) | 2541 |

TABLE 5-continued

CONSTRUCTS USED FOR EVALUATION OF PREDICTED LOCI

| Construct name | Sequence | Length |
| --- | --- | --- |
| pARBI-698: TRAC_1_Exogenous_79 | TAATGCCCAGCCTAAGTTGGGGAGACCACTCCAGATTCCAAGATGTACAGTTTGCTT<br>TGCTGGGCCTTTTTCCCATGCCTGCCTTTACTCTGCCAGAGTTATATTGCTGGGGTTT<br>TGAAGAAGATCCTATTAAATAAAAGAATAAGCAGTATTATTAAGTAGCCCTGCATTT<br>CAGGTTTCCTTGAGTGGCAGGCCAGGCCTGGCCGTGAACGTTCACTGAAATCATGG<br>CCTCTTGGCCAAGATTGATAGCTTGTGCCTGTCCCTGAGTCCCAGTCCATCACGAGC<br>AGCTGGTTTCTAAGATGCTATTTCCCGTATAAAGCATGAGACCGTGACTTGCCAGCC<br>CCACAGAGCCCCGCCCTTGTCCATCACTGGCATCTGGACTCCAGCCTGGGTTGGGGC<br>AAAGAGGGAAATGAGATCATGTCCTAACCCTGATCCTCTTGTCCCACAGATtgacgact<br>gtgccttctagttgccagccatctgttgtttgcccctccccgtgccttccttgaccctggaaggtgccactcccac<br>tgtcctttcctaataaaatgaggaaattgcatcgcattgtctgagtaggtgtcattctattctgggggtggggtg<br>gggcaggacagcaaggggaggattgggaagacaatagcaggcatgctggggatgcggtgggctctatggG<br>GATCTGCGATCGCTCCGGTGCCCGTCAGTGGGCAGAGCGCACATCGCCCACAGTCC<br>CCGAGAAGTTGGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT<br>GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAAatgattgtttattgcag<br>cttataatggttacaaataaagcaatagcatcacaaatttcacaaataaagcatttttttcactgcattctagttg<br>tggtttgtccaaactcatcaatgtatcttatATCCAGAACCCTGACCCTGCCGTGTACCAGCTGA<br>GAGACTCTAAATCCAGTGACAAGTCTGTCTGCCTATTCACCGATTTTGATTCTCAAAC<br>AAATGTGTCACAAAGTAAGGATTCTGATGTGTATATCACAGACAAAACTGTGCTAGA<br>CATGAGGTCTATGGACTTCAAGAGCAACAGTGCTGTGGCCTGGAGCAACAAATCTG<br>ACTTTGCATGTGCAAACGCCTTCAACAACAGCATTATTCCAGAAGACACCTTCTTCCC<br>CAGCCCAGGTAAGGGCAGCTTTGGTGCCTTCGCAGGCTGTTTCCTTGCTTCAGGAAT<br>GGCCAGGTTCTGCCCAGAGCTCTGGTCAATGATGTCTAAAACTCCTCTGATTGGTGG<br>TCTCGGCCTTATCCATTGCCACCAAAACCCTCTTTTTACTAAGAAACAGTGAGCCTTG<br>TTCTGGCAGTCCAGA (SEQ ID NO: 303) | 2541 |
| pARBI-699: RAC_2_Exogenous_80 | GATTCCAAGATGTACAGTTTGCTTTGCTGGGCCTTTTTCCCATGCCTGCCTTTACTCTG<br>CCAGAGTTATATTGCTGGGGTTTTGAAGAAGATCCTATTAAATAAAAGAATAAGCAG<br>TATTATTAAGTAGCCCTGCATTTCAGGTTTCCTTGAGTGGCAGGCCAGGCCTGGCCG<br>TGAACGTTCACTGAAATCATGGCCTCTTGGCCAAGATTGATAGCTTGTGCCTGTCCCT<br>GAGTCCCAGTCCATCACGAGCAGCTGGTTTCTAAGATGCTATTTCCCGTATAAAGCA<br>TGAGACCGTGACTTGCCAGCCCCACAGAGCCCCGCCCTTGTCCATCACTGGCATCTG<br>GACTCCAGCCTGGGTTGGGGCAAAGAGGGAAATGAGATCATGTCCTAACCCTGATC<br>CTCTTGTCCCACAGATATCCAGAACCCTGACCCTGCCGTGTACCAGCTGtgacgactgtg<br>cccttctagttgccagccatctgttgtttgcccctccccgtgccttccttgaccctggaaggtgccactcccactgt<br>ccctttcctaataaaatgaggaaattgcatcgcattgtctgagtaggtgtcattctattctgggggtggggtggg<br>gcaggacagcaaggggaggattgggaagacaatagcaggcatgctggggatgcggtgggctctatggGG<br>ATCTGCGATCGCTCCGGTGCCCGTCAGTGGGCAGAGCGCACATCGCCCACAGTCCCC<br>GAGAAGTTGGGGGGAGGGGTCGGCAATTGAACGGGTGCCTAGAGAAGGTGGCGC<br>GGGGTAAACTGGGAAAGTGATGTCGTGTACTGGCTCCGCCTTTTTCCCGAGGGTGG<br>GGGAGAACCGTATATAAGTGCAGTAGTCGCCGTGAACGTTCTTTTTCGCAACGGGTT<br>TGCCGCCAGAACACAGCTGAAGCTTCGAGGGGCTCGCATCTCTCCTTCACGCGCCCG<br>CCGCCCTACCTGAGGCCGCCATCCACGCCGGTTGAGTCGCGTTCTGCCGCCTCCCGC<br>CTGTGGTGCCTCCTGAACTGCGTCCGCCGTCTAGGTAAGTTTAAAGCTCAGGTCGAG<br>ACCGGGCCTTTGTCCGGCGCTCCCTTGGAGCCTACCTAGACTCAGCCGGCTCTCCAC<br>GCTTTGCCTGACCCTGCTTGCTCAACTCTACGTCTTTGTTTCGTTTTCTGTTCTGCGCC<br>GTTACAGATCCAAGCTGTGACCGGCGCCTACTCTAGAGCTAGCGAATTgccgccaccAT<br>GGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGAGGGCGATG<br>CCACCTACGGCAAGCTGACCCTGAAGTTCATCTGCACCACCGGCAAGCTGCCCGTGC<br>CCTGGCCCACCCTCGTGACCACCCTGACCTACGGCGTGCAGTGCTTCAGCCGCTACC<br>CCGACCACATGAAGCAGCACGACTTCTTCAAGTCCGCCATGCCCGAAGGCTACGTCC<br>AGGAGCGCACCATCTTCTTCAAGGACGACGGCAACTACAAGACCCGCGCCGAGGTG<br>AAGTTCGAGGGCGACACCCTGGTGAACCGCATCGAGCTGAAGGGCATCGACTTCAA<br>GGAGGACGGCAACATCCTGGGGCACAAGCTGGAGTACAACTACAACAGCCACAAC | 2541 |

TABLE 5-continued

CONSTRUCTS USED FOR EVALUATION OF PREDICTED LOCI

| Construct name | Sequence | Length |
|---|---|---|
| | GTCTATATCATGGCCGACAAGCAGAAGAACGGCATCAAGGTGAACTTCAAGATCCG<br>CCACAACATCGAGGACGGCAGCGTGCAGCTCGCCGACCACTACCAGCAGAACACCC<br>CCATCGGCGACGCCCCCGTGCTGCTGCCCGACAACCACTACCTGAGCACCCAGTCCA<br>AGCTGAGCAAAGACCCCAACGAGAAGCGCGATCACATGGTCCTGCTGGAGTTCGTG<br>ACCGCCGCCGGGATCACTCTCGGCATGGACGAGCTGTACAAatgattgtttattgcagcttat<br>aatggttacaaataaagcaatagcatcacaaatttcacaaataaagcatttttttcactgcattctagttgtggtt<br>tgtccaaactcatcaatgtatcttatAGAGAACTCTAAATCCAGTGACAAGTCTGTCTGCCTATT<br>CACCGATTTTGATTCTCAAACAAATGTGTCACAAAGTAAGGATTCTGATGTGTATATC<br>ACAGACAAAACTGTGCTAGACATGAGGTCTATGGACTTCAAGAGCAACAGTGCTGT<br>GGCCTGGAGCAACAAATCTGACTTTGCATGTGCAAACGCCTTCAACAACAGCATTAT<br>TCCAGAAGACACCTTCTTCCCCAGCCCAGGTAAGGGCAGCTTTGGTGCCTTCGCAGG<br>CTGTTTCCTTGCTTCAGGAATGGCCAGGTTCTGCCCAGAGCTCTGGTCAATGATGTCT<br>AAAACTCCTCTGATTGGTGGTCTCGGCCTTATCCATTGCCACCAAAACCCTCTTTTTAC<br>TAAGAAACAGTGAGCCTTGTTCTGGCAGTCCAGAGAATGACACGGGAAAAAAGCAG<br>ATGAAGAGAAG (SEQ ID NO: 304) | |
| pARBI-700:<br>TRAC_3_Ex<br>ogenous_81 | TTCCTGTGGTAGCGGAACTCACTAAGGGGCCCATCTGGACCCGAGGTATTGTGATG<br>ATAAATTCTGAGCACCTACCCCATCCCCAGAAGGGCTCAGAAATAAAATAAGAGCCA<br>AGTCTAGTCGGTGTTTCCTGTCTTGAAACACAATACTGTTGGCCCTGGAAGAATGCA<br>CAGAATCTGTTTGTAAGGGGATATGCACAGAAGCTGCAAGGGACAGGAGGTGCAG<br>GAGCTGCAGGCCTCCCCCACCCAGCCTGCTCTGCCTTGGGGAAAACCGTGGGTGTG<br>TCCTGCAGGCCATGCAGGCCTGGGACATGCAAGCCCATAACCGCTGTGGCCTCTTG<br>GTTTTACAGATACGAACCTAAACTTTCAAAACCTGTCAGTGATTGGGTTCCGAATCCT<br>CCTCCTGAAAGTGGCCGGGTTTAATCTGCTCATGACGCTGCGGTCTGTGGTCCAGCtg<br>acgactgtgccttctagttgccagccatctgttgtttgccctccccgtgccttccttgacctggaaggtgccac<br>tcccactgtcctttcctaataaaatgaggaaattgcatcgcattgtctgagtaggtgtcattctattctgggggt<br>ggggtggggcaggacagcaaggggaggattgggaagacaatagcaggcatgctgggatgcggtgggctc<br>tatgGGATCTGCGATCGCTCCGGTGCCCGTCAGTGGGCAGAGCGCACATCGCCCAC<br>AGTCCCCGAGAAGTTGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCTGCGCCGTTACAGATCCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGCCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatcttatTGAGGTGAGGGGCCTTGAAGCTGGGA<br>GTGGGGTTTAGGGACGCGGGTCTCTGGGTGCATCCTAAGCTCTGAGAGCAAACCTC<br>CCTGCAGGGTCTTGCTTTTAAGTCCAAAGCCTGAGCCCACCAAACTCCTACTTCTT<br>CCTGTTACAAATTCCTCTTGTGCAATAATAATGGCCTGAAACGCTGTAAAATATCCTC<br>ATTTCAGCCGCCTCAGTTGCACTTCTCCCCTATGAGGTAGGAAGAACAGTTGTTTAG<br>AAACGAAGAAACTGAGGCCCCACAGCTAATGAGTGGAGGAAGAGAGACACTTGTG<br>TACACCACATGCCTTGTGTTGTACTTCTCTCACCGTGTAACCTCCTCATGTCCTCTCTC<br>CCCAGTACGGCTCTCTTAGCTCAGTAGAAAGAAGACATTACACTCATATTACACCCCA<br>ATCCTGGCTAGAGTCTCCGCACC (SEQ ID NO: 305) | 2541 |
| pARBI-701:<br>TRAC_4_Ex<br>ogenous_82 | ATTATTAAGTAGCCCTGCATTTCAGGTTTCCTTGAGTGGCAGGCCAGGCCTGGCCGT<br>GAACGTTCACTGAAATCATGGCCTCTTGGCCAAGATTGATAGCTTGTGCCTGTCCCT<br>GAGTCCCAGTCCATCACGAGCAGCTGGTTTCTAAGATGCTATTTCCCGTATAAAGCA<br>TGAGACCGTGACTTGCCAGCCCCACAGAGCCCCGCCCTTGTCCATCACTGGCATCTG<br>GACTCCAGCCTGGGTTGGGGCAAAGAGGGAAATGAGATCATGTCCTAACCCTGATC<br>CTCTTGTCCCACAGATATCCAGAACCCTGACCCTGCCGTGTACCAGCTGAGAGACTC<br>TAAATCCAGTGACAAGTCTGTCTGCCTATTCACCGATTTTGATTCTCAAACAAATGTG<br>TCACAAAGTAAGGATTCTGATGTGTATATCACAGACAAAACTGTGCTAGACtgacgact<br>gtgccttctagttgccagccatctgttgtttgccctccccgtgccttccttgacctggaaggtgccactcccac<br>tgtcctttcctaataaaatgaggaaattgcatcgcattgtctgagtaggtgtcattctattctgggggtggggtg<br>gggcaggacagcaaggggaggattgggaagacaatagcaggcatgctgggatgcggtgggctctatggG<br>GATCTGCGATCGCTCCGGTGCCCGTCAGTGGGCAGAGCGCACATCGCCCACAGTCC<br>CCGAGAAGTTGGGGGAGGGGTCGGCAATTGAACGGGTGCCTAGAGAAGGTGGC<br>GCGGGGTAAACTGGGAAAGTGATGTCGTGTACTGGCTCCGCCTTTTTCCCGAGGGT | 2541 |

TABLE 5-continued

CONSTRUCTS USED FOR EVALUATION OF PREDICTED LOCI

| Construct name | Sequence | Length |
| --- | --- | --- |
| | GGGGGAGAACCGTATATAAGTGCAGTAGTCGCCGTGAACGTTCTTTTTCGCAACGG<br>GTTTGCCGCCAGAACACAGCTGAAGCTTCGAGGGGCTCGCATCTCTCCTTCACGCGC<br>CCGCCGCCCTACCTGAGGCCGCCATCCACGCCGGTTGAGTCGCGTTCTGCCGCCTCC<br>CGCCTGTGGTGCCTCCTGAACTGCGTCCGCCGTCTAGGTAAGTTTAAAGCTCAGGTC<br>GAGACCGGGCCTTTGTCCGGCGCTCCCTTGGAGCCTACCTAGACTCAGCCGGCTCTC<br>CACGCTTTGCCTGACCCTGCTTGCTCAACTCTACGTCTTTGTTTCGTTTTCTGTTCTGC<br>GCCGTTACAGATCCAAGCTGTGACCGGCGCCTACTCTAGAGCTAGCGAATTgccgcca<br>ccATGGTGAGCAAGGGCGAGGAGCTGTTCACCGGGGTGGTGCCCATCCTGGTCGAG<br>CTGGACGGCGACGTAAACGGCCACAAGTTCAGCGTGTCCGGCGAGGGCGAGGGCG<br>ATGCCACCTACGGCAAGCTGACCCTGAAGTTCATCTGCACCACCGGCAAGCTGCCCG<br>TGCCCTGGCCCACCCTCGTGACCACCCTGACCTACGGCGTGCAGTGCTTCAGCCGCT<br>ACCCCGACCACATGAAGCAGCACGACTTCTTCAAGTCCGCCATGCCCGAAGGCTACG<br>TCCAGGAGCGCACCATCTTCTTCAAGGACGACGGCAACTACAAGACCCGCGCCGAG<br>GTGAAGTTCGAGGGCGACACCCTGGTGAACCGCATCGAGCTGAAGGGCATCGACTT<br>CAAGGAGGACGGCAACATCCTGGGGCACAAGCTGGAGTACAACTACAACAGCCAC<br>AACGTCTATATCATGGCCGACAAGCAGAAGAACGGCATCAAGGTGAACTTCAAGAT<br>CCGCCACAACATCGAGGACGGCAGCGTGCAGCTCGCCGACCACTACCAGCAGAACA<br>CCCCCATCGGCGACGGCCCCGTGCTGCTGCCCGACAACCACTACCTGAGCACCCAGT<br>CCAAGCTGAGCAAAGACCCCAACGAGAAGCGCGATCACATGGTCCTGCTGGAGTTC<br>GTGACCGCCGCCGGGATCACTCTCGGCATGGACGAGCTGTACAAatgattgtttattgcag<br>cttataatggttacaaataaagcaatagcatcacaaatttcacaaataaagcattttttttcactgcattctagttg<br>tggtttgtccaaactcatcaatgtatcttatATGAGGTCTATGGACTTCAAGAGCAACAGTGCTG<br>TGGCCTGGAGCAACAAATCTGACTTTGCATGTGCAAACGCCTTCAACAACAGCATTA<br>TTCCAGAAGACACCTTCTTCCCCAGCCCAGGTAAGGGCAGCTTTGGTGCCTTCGCAG<br>GCTGTTTCCTTGCTTCAGGAATGGCCAGGTTCTGCCCAGAGCTCTGGTCAATGATGT<br>CTAAAACTCCTCTGATTGGTGGTCTCGGCCTTATCCATTGCCACCAAAACCCTCTTTTT<br>ACTAAGAAACAGTGAGCCTTGTTCTGGCAGTCCAGAGAATGACACGGGAAAAAAGC<br>AGATGAAGAGAAGGTGGCAGGAGAGGGCACGTGGCCCAGCCTCAGTCTCTCCAAC<br>TGAGTTCCTGCCTGCCTGCCTTTGCTCAGACTGTTTGCCCCCTTACTGCTCTTCTAGGCC<br>TCATTCTAAGCCCCTT (SEQ ID NO: 306) | |
| pARBI-702:<br>TRAC_6_Ex<br>ogenous_8 | TTCATTTCCATTTGAGTTGTTCTTATTGAGTCATCCTTCCTGTGGTAGCGGAACTCACT<br>AAGGGGCCCATCTGGACCCGAGGTATTGTGATGATAAATTCTGAGCACCTACCCCAT<br>CCCCAGAAGGGCTCAGAAATAAAATAAGAGCCAAGTCTAGTCGGTGTTTCCTGTCTT<br>4GAAACACAATACTGTTGGCCCTGGAAGAATGCACAGAATCTGTTTGTAAGGGGATA<br>TGCACAGAAGCTGCAAGGGACAGGAGGTGCAGGAGCTGCAGGCCTCCCCCACCCA<br>GCCTGCTCTGCCTTGGGGAAAACCGTGGGTGTGTCCTGCAGGCCATGCAGGCCTGG<br>GACATGCAAGCCCATAACCGCTGTGGCCTCTTGGTTTTACAGATACGAACCTAAACT<br>TTCAAAACCTGTCAGTGATTGGGTTCCGAATCCTCCTCCTGAAAGTGGCCGGGtgacg<br>actgtgccttctagttgccagccatctgttgtttgccctccccgtgccttccttgaccctggaaggtgccactcc<br>cactgtcctttcctaataaaatgaggaaattgcatcgcattgtctgagtaggtgtcattctattctgggggtggg<br>gtggggcaggacagcaaggggggaggattgggaagacaatagcaggcatgctggggatgcggtgggctctat<br>ggGGATCTGCGATCGCTCCGGTGCCCGTCAGTGGGCAGAGCGCACATCGCCCACAG<br>TCCCCGAGAAGTTGGGGGAGGGGTCGGCAATTGAACGGGTGCCTAGAGAAGGTG<br>GCGCGGGGTAAACTGGGAAAGTGATGTCGTGTACTGGCTCCGCCTTTTTCCCGAGG<br>GTGGGGGAGAACCGTATATAAGTGCAGTAGTCGCCGTGAACGTTCTTTTTCGCAAC<br>GGGTTTGCCGCCAGAACACAGCTGAAGCTTCGAGGGGCTCGCATCTCTCCTTCACGC<br>GCCCGCCGCCCTACCTGAGGCCGCCATCCACGCCGGTTGAGTCGCGTTCTGCCGCCT<br>CCCGCCTGTGGTGCCTCCTGAACTGCGTCCGCCGTCTAGGTAAGTTTAAAGCTCAGG<br>TCGAGACCGGGCCTTTGTCCGGCGCTCCCTTGGAGCCTACCTAGACTCAGCCGGCTC<br>TCCACGCTTTGCCTGACCCTGCTGCTCAACTCTACGTCTTTGTTTCGTTTTCTGTTCT<br>GCGCCGTTACAGATCCAAGCTGTGACCGGCGCCTACTCTAGAGCTAGCGAATTgccgc<br>caccATGGTGAGCAAGGGCGAGGAGCTGTTCACCGGGGTGGTGCCCATCCTGGTCG<br>AGCTGGACGGCGACGTAAACGGCCACAAGTTCAGCGTGTCCGGCGAGGGCGAGGG<br>CGATGCCACCTACGGCAAGCTGACCCTGAAGTTCATCTGCACCACCGGCAAGCTGCC<br>CGTGCCCTGGCCCACCCTCGTGACCACCCTGACCTACGGCGTGCAGTGCTTCAGCCG<br>CTACCCCGACCACATGAAGCAGCACGACTTCTTCAAGTCCGCCATGCCCGAAGGCTA<br>CGTCCAGGAGCGCACCATCTTCTTCAAGGACGACGGCAACTACAAGACCCGCGCCG<br>AGGTGAAGTTCGAGGGCGACACCCTGGTGAACCGCATCGAGCTGAAGGGCATCGA<br>CTTCAAGGAGGACGGCAACATCCTGGGGCACAAGCTGGAGTACAACTACAACAGCC<br>ACAACGTCTATATCATGGCCGACAAGCAGAAGAACGGCATCAAGGTGAACTTCAAG<br>ATCCGCCACAACATCGAGGACGGCAGCGTGCAGCTCGCCGACCACTACCAGCAGAA<br>CACCCCCATCGGCGACGGCCCCGTGCTGCTGCCCGACAACCACTACCTGAGCACCCA<br>GTCCAAGCTGAGCAAAGACCCCAACGAGAAGCGCGATCACATGGTCCTGCTGGAGT<br>TCGTGACCGCCGCCGGGATCACTCTCGGCATGGACGAGCTGTACAAatgattgtttattgc<br>agcttataatggttacaaataaagcaatagcatcacaaatttcacaaataaagcattttttttcactgcattctag<br>ttgtggtttgtccaaactcatcaatgtatcttatTTTAATCTGCTCATGACGCTGCGGCTGTGGTCC<br>AGCTGAGGTGAGGGCCTTGAAGCTGGGAGTGGGGTTTAGGGACGCGGGTCTCTG<br>GGTGCATCCTAAGCTCTGAGAGCAAACCTCCCTGCAGGGTCTTGCTTTTAAGTCCAA<br>AGCCTGAGCCCACCAAACTCTCCTACTTCTTCCTGTTACAAATTCCTCTTGTGCAATAA<br>TAATGGCCTGAAACGCTGTAAAATATCCTCATTTCAGCCGCCTCAGTTGCACTTCTCC<br>CCTATGAGGTAGGAAGAACAGTTGTTTAGAAACGAAGAAACTGAGGCCCCACAGCT<br>AATGAGTGGAGGAAGAGAGACACTTGTGTACACCACATGCCTTGTGTTGTACTTCTC<br>TCACCGTGTAACCTCCTCATGTCCTCTCTCCCAGTACGGCTCTCTTAGCTCAGTAGA<br>AAGAAGACATTACACTC (SEQ ID NO: 307) | 2541 |

TABLE 5-continued

CONSTRUCTS USED FOR EVALUATION OF PREDICTED LOCI

| Construct name | Sequence | Length |
| --- | --- | --- |
| pARBI-703: TRAC_Exogenous_83 | CAGTCCATCACGAGCAGCTGGTTTCTAAGATGCTATTTCCCGTATAAAGCATGAGAC CGTGACTTGCCAGCCCCACAGAGCCCGCCCTTGTCCATCACTGGCATCTGGACTCC AGCCTGGGTTGGGGCAAAGAGGGAAATGAGATCATGTCCTAACCCTGATCCTCTTG TCCCACAGATATCCAGAACCCTGACCCTGCCGTGTACCAGCTGAGAGACTCTAAATC CAGTGACAAGTCTGTCTGCCTATTCACCGATTTTGATTCTCAAACAAATGTGTCACAA AGTAAGGATTCTGATGTGTATATCACAGACAAAACTGTCTAGACATGAGGTCTATG GACTTCAAGAGCAACAGTGCTGTGGCCTGGAGCAACAAATCTGACTTTGCATGTGC AAACGCCTTCAACAACAGCATTATTCCAGAAGACACCTTCTTCCCCAGCCCAtgacgact gtgccttctagttgccagccatctgttgtttgcccctccccgtgccttccttgaccctggaaggtgccactcccac tgtcctttcctaataaaatgaggaaattgcatcgcattgtctgagtaggtgtcattctattctggggggtggggtg gggcaggacagcaaggggaggattgggaagacaatagcaggcatgctgggatgcggtgggctctatggG GATCTGCGATCGCTCCGGTGCCCGTCAGTGGGCAGAGCGCACATCGCCCACAGTCC CCGAGAAGTTGGGGGGAGGGGTCGGCAATTGAACGGGTGCCTAGAGAAGGTGGC GCGGGGTAAACTGGGAAAGTGATGTCGTGTACTGGCTCCGCCTTTTTCCCGAGGGT GGGGGGAGAACCGTATATAAGTGCAGTAGTCGCCGTGAACGTTCTTTTTCGCAACGG GTTTGCCGCCAGAACACAGCTGAAGCTTCGAGGGGCTCGCATCTCTCCTTCACGCGC CCGCCGCCCTACCTGAGGCCGCCATCCACGCCGGTTGAGTCGCGTTCTGCCGCCTCC CGCCTGTGGTGCCTCCTGAACTGCGTCCGCCGTCTAGGTAAGTTTAAAGCTCAGGTC GAGACCGGGCCTTTGTCCGGCGCTCCCTTGGAGCCTACCTAGACTCAGCCGGCTCTC CACGCTTTGCCTGACCCTGCTTGCTCAACTCTACGTCTTTGTTTCGTTTTCTGTTCTGC GCCGTTACAGATCCAAGCTGTGACCGGCGCCTACTCTAGAGCTAGCGAATTgccgcca ccATGGTGAGCAAGGGCGAGGAGCTGTTCACCGGGGTGGTGCCCATCCTGGTCGAG CTGGACGGCGACGTAAACGGCCACAAGTTCAGCGTGTCCGGCGAGGGCGAGGCG ATGCCACCTACGGCAAGCTGACCCTGAAGTTCATCTGCACCACCGGCAAGCTGCCCG TGCCCTGGCCCACCCTCGTGACCACCCTGACCTACGGCGTGCAGTGCTTCAGCCGCT ACCCCGACCACATGAAGCAGCACGACTTCTTCAAGTCCGCCATGCCCGAAGGCTACG TCCAGGAGCGCACCATCTTCTTCAAGGACGACGGCAACTACAAGACCCGCGCCGAG GTGAAGTTCGAGGGCGACACCCTGGTGAACCGCATCGAGCTGAAGGGCATCGACTT CAAGGAGGACGGCAACATCCTGGGGCACAAGCTGGAGTACAACTACAACAGCCAC AACGTCTATATCATGGCCGACAAGCAGAAGAACGGCATCAAGGTGAACTTCAAGAT CCGCCACAACATCGAGGACGGCAGCGTGCAGCTCGCCGACCACTACCAGCAGAACA CCCCCATCGGCGACGGCCCCGTGCTGCTGCCCGACAACCACTACCTGAGCACCCAGT CCAAGCTGAGCAAAGACCCCAACGAGAAGCGCGATCACATGGTCCTGCTGGAGTTC GTGACCGCCGCCGGGATCACTCTCGGCATGGACGAGCTGTACAAAatgattgtttattgcag cttataatggttacaaataaagcaatagcatcacaaatttcacaaataaagcatttttttcactgcattctagttg tggtttgtccaaactcatcaatgtatcttatGGTAAGGGCAGCTTTGGTGCCTTCGCAGGCTGTT TCCTTGCTTCAGGAATGGCCAGGTTCTGCCCAGAGCTCTGGTCAATGATGTCTAAAA CTCCTCTGATTGGTGGTCTCGGCCTTATCCATTGCCACCAAAACCCTCTTTTTACTAAG AAACAGTGAGCCTTGTTCTGGCAGTCCAGAGAATGACACGGGAAAAAAGCAGATGA AGAGAAGGTGGCAGGAGAGGGCACGTGGCCCAGCCTCAGTCTCTCCAACTGAGTTC CTGCCTGCCTGCCTTTGCTCAGACTGTTTGCCCCTTACTGCTCTTCTAGGCCTCATTCT AAGCCCCTTCTCCAAGTTGCCTCTCCTTATTTCTCCTGTCTGCCAAAAAATCTTTCCC AGCTCACTAAGTCAGTCTCACGCAGTCACTCATTAACCCACCAATCACTGATTGTGCC GGCACATGAATG (SEQ ID NO: 308) | 2541 |
| pARBI-704: TRIM28_1_Exogenous_85 | TGAGGAAGAAGCGCGGGCGGCGCCTTCGGGAGGCGAGCAGGCAGCAGTTGGCCG TGCCGTAGCAGCGTCCCGCGCGCGGCGGGCAGCGGCCCAGGAGGCGCGTGGCGGC GCTCGGCCTCGCGGCGGCGGCGGCGAGCGGCCAGCAGTTGGCGGCGAGCGCG TCTGCGCCTGCGCGGCGGGCCCCGCGCCCCTCCTCCCCCCTGGGCGCCCCCGGCGG CGTGTGAATGGCGGCCTCCGCGGCGGCAGCCTCGGCAGCAGCGGCCTCGGCCGCCT CTGGCAGCCCGGGCCCGGGCGAGGGCTCCGCTGGCGGCGAAAAGCGCTCCACCGC CCCTTCCGCCAGCCTCGGCCTCTGCCTCAGCCGCCGCGTCGTCGCCCGCGGGGG GCGGCGCCGAGGCGCTGGAGCTGCTGGAGCACTGCGGCGTGTGCAGAGAGCGCCT GCGACCCTgacgactgtgccttctagttgccagccatctgttgtttgcccctccccgtgccttccttgaccctg gaaggtgccactcccactgtcctttcctaataaaatgaggaaattgcatcgcattgtctgagtaggtgtcattct attctggggggtggggtgggcaggacagcaaggggaggattgggaagacaatagcaggcatgctgggga tgcggtgggctctatggGGATCTGCGATCGCTCCGGTGCCCGTCAGTGGGCAGAGCGCAC ATCGCCCACAGTCCCCGAGAAGTTGGGGGGAGGGGTCGGCAATTGAACGGGTGCC TAGAGAAGGTGGCGCGGGGTAAACTGGGAAAGTGATGTCGTGTACTGGCTCCGCC TTTTTCCCGAGGGTGGGGGAGAACCGTATATAAGTGCAGTAGTCGCCGTGAACGTT CTTTTTCGCAACGGGTTTGCCGCCAGAACACAGCTGAAGCTTCGAGGGGCTCGCATC TCTCCTTCACGCGCCCGCCGCCCTACCTGAGGCCGCCATCCACGCCGGTTGAGTCGC GTTCTGCCGCCTCCCGCCTGTGGTGCCTCCTGAACTGCGTCCGCCGTCTAGGTAAGT TTAAAGCTCAGGTCGAGACCGGGCCTTTGTCCGGCGCTCCCTTGGAGCCTACCTAGA CTCAGCCGGCTCTCCACGCTTTGCCTGACCCTGCTTGCTCAACTCTACGTCTTTGTTTC GTTTTCTGTTCTGCGCCGTTACAGATCCAAGCTGTGACCGGCGCCTACTCTAGAGCTA GCGAATTgccgccaccATGGTGAGCAAGGGCGAGGAGCTGTTCACCGGGGTGGTGCC CATCCTGGTCGAGCTGGACGGCGACGTAAACGGCCACAAGTTCAGCGTGTCCGGCG AGGGCGAGGGCGATGCCACCTACGGCAAGCTGACCCTGAAGTTCATCTGCACCACC GGCAAGCTGCCCGTGCCCTGGCCCACCCTCGTGACCACCCTGACCTACGGCGTGCAG TGCTTCAGCCGCTACCCCGACCACATGAAGCAGCACGACTTCTTCAAGTCCGCCATG CCCGAAGGCTACGTCCAGGAGCGCACCATCTTCTTCAAGGACGACGGCAACTACAA GACCCGCGCCGAGGTGAAGTTCGAGGGCGACACCCTGGTGAACCGCATCGAGCTG AAGGGCATCGACTTCAAGGAGGACGGCAACATCCTGGGGCACAAGCTGGAGTACA | 2541 |

TABLE 5-continued

CONSTRUCTS USED FOR EVALUATION OF PREDICTED LOCI

| Construct name | Sequence | Length |
|---|---|---|
| | ACTACAACAGCCACAACGTCTATATCATGGCCGACAAGCAGAAGAACGGCATCAAG<br>GTGAACTTCAAGATCCGCCACAACATCGAGGACGGCAGCGTGCAGCTCGCCGACCA<br>CTACCAGCAGAACACCCCCATCGGCGACGCCCCCGTGCTGCTGCCCGACAACCACTA<br>CCTGAGCACCCAGTCCAAGCTGAGCAAAGACCCCAACGAGAAGCGCGATCACATGG<br>TCCTGCTGGAGTTCGTGACCGCCGCCGGGATCACTCTCGGCATGGACGAGCTGTAC<br>AAatgattgtttattgcagcttataatggttacaaataaagcaatagcatcacaaatttcacaaataaagcatt<br>tttttcactgcattctagttgtggtttgtccaaactcatcaatgtatcttatGAGAGGGAGCCCCGCCTGC<br>TGCCCTGTTTGCACTCGGCCTGTAGTGCCTGCTTAGGGCCCGCGGCCCCGCCGCCG<br>CCAACAGCTCGGGGACGGCGGGGCGGCGGGCGACGGCACCGGTAAGTACGAAG<br>TGATCGGTGCCACCCCTCCCCCTACTCTCTGCCTTTGATTCCGACTGGGTGCAGAGAT<br>GAGGATGCCACCTGGGCGAGAGGATGGGGGCCCGGACAGGGCACGGGAAATACT<br>TTCTGGGTCCTGCATACGAACGTGGGTTTGTGCTGGCCGCTGAGATGGGACATCTG<br>ACTAAAGTTGGAGAAAAGAAGGCTCGGGGAGGGGAGGGGCTGGTTCGCTGCGGG<br>ATAATGGTCGGGGGCCCACCCAGCAGGGGAATGGTGGGGGCCATAACCTGGGTGG<br>GAACTTGTAACAGTCTCCCACATCCCTGCTTCTCGAAGTGGTG (SEQ ID NO: 309) | |
| pARBI-705:<br>TRIM28_2_<br>Exogenous_<br>86 | TCGAAGTGGTGGACTGTCCCGTGTGCAAGCAACAGTGCTTCTCCAAAGACATCGTG<br>GAGAATTATTTCATGCGTGATAGTGGCAGCAAGGCTGCCACCGACGCCCAGGATGC<br>GAACCAGGTGCGTCCTATCTCAGCAACCACAAGGAGGTTTCTGGGGAGGGGCATC<br>TGCGCAGGAGGAGCTTGGCACCAGCTCCAGGCTGTTACTCCACTTTCCCAAGGCTCT<br>GGGTGGGCTGCCTAGGTTGGGTCAAGGGACCAATCTTAAATCTCCGGTTGTATTTTC<br>TGGGATGTAAACGTGGATCTATCAAGTTGTCTTGCCTTCTCTGACCCTGCCTTTGTCT<br>GGCAGTGCTGCACTAGCTGTGAGGATAATGCCCCAGCCACCAGCTACTGTGTGGAG<br>TGCTCGGAGCCTCTGTGTGAGACCTGTGTAGAGGCGCACCAGCGGGTGAAGTACtg<br>acgactgtgccttctagttgccagccatctgttgtttgccctccccgtgccttccttgaccctggaaggtgccac<br>tcccactgtcctttcctaataaaatgaggaaattgcatcgcattgtctgagtaggtgtcattctattctgggggt<br>ggggtggggcaggacagcaaggggaggattgggaagacaatagcaggcatgctgggatgcggtgggctc<br>tatggGGATCTGCGATCGCTCCGGTGCCCGTCAGTGGGCAGAGCGCACATCGCCCAC<br>AGTCCCCGAGAAGTTGGGGGGAGGGGTCGGCAATTGAACGGGTGCCTAGAGAAG<br>GTGGCGCGGGGTAAACTGGGAAAGTGATGTCGTGTACTGGCTCCGCCTTTTTCCCG<br>AGGGTGGGGGAGAACCGTATATAAGTGCAGTAGTCGCCGTGAACGTTCTTTTTCGC<br>AACGGGTTTGCCGCCAGAACACAGCTGAAGCTTCGAGGGGCTCGCATCTCTCCTTCA<br>CGCGCCCGCCGCCCTACCTGAGGCCGCCATCCACGCCGGTTGAGTCGCGTTCTGCCG<br>CCTCCCGCCTGTGGTGCCTCCTGAACTGCGTCCGCCGTCTAGGTAAGTTTAAAGCTC<br>AGGTCGAGACCGGGCCTTTGTCCGGCGCTCCCTTGGAGCCTACCTAGACTCAGCCG<br>GCTCTCCACGCTTTGCCTGACCCTGCTTGCTCAACTCTACGTCTTTGTTTCGTTTTCTG<br>TTCGTGCGCGTTACAGATCAAGCTGTGACCGGCGCCTACTCTAGAGCTAGCGAATT<br>gccgccaccATGGTGAGCAAGGGCGAGGAGCTGTTCACCGGGGTGGTGCCCATCCTG<br>GTCGAGCTGGACGGCGACGTAAACGGCCACAAGTTCAGCGTGTCCGGCGAGGGCG<br>AGGGCGATGCCACCTACGGCAAGCTGACCCTGAAGTTCATCTGCACCACCGGCAAG<br>CTGCCCGTGCCCTGGCCCACCCTCGTGACCACCCTGACCTACGGCGTGCAGTGCTTC<br>AGCCGCTACCCCGACCACATGAAGCAGCACGACTTCTTCAAGTCCGCCATGCCCGAA<br>GGCTACGTCCAGGAGCGCACCATCTTCTTCAAGGACGACGGCAACTACAAGACCCG<br>CGCCGAGGTGAAGTTCGAGGGCGACACCCTGGTGAACCGCATCGAGCTGAAGGGC<br>ATCGACTTCAAGGAGGACGGCAACATCCTGGGGCACAAGCTGGAGTACAACTACAA<br>CAGCCACAACGTCTATATCATGGCCGACAAGCAGAAGAACGGCATCAAGGTGAACT<br>TCAAGATCCGCCACAACATCGAGGACGGCAGCGTGCAGCTCGCCGACCACTACCAG<br>CAGAACACCCCCATCGGCGACGCCCCCGTGCTGCTGCCCGACAACCACTACCTGAGC<br>ACCCAGTCCAAGCTGAGCAAAGACCCCAACGAGAAGCGCGATCACATGGTCCTGCT<br>GGAGTTCGTGACCGCCGCCGGGATCACTCTCGGCATGGACGAGCTGTACAAatgattg<br>tttattgcagcttataatggttacaaataaagcaatagcatcacaaatttcacaaataaagcatttttttcactgc<br>attctagttgtggtttgtccaaactcatcaatgtatcttatACCAAGGACCATACTGTGCGCTCTACT<br>GGTACATGAGGCTGAGGGGGCTGTTGGAGTTGTTCTCCCATGTGTGCCCTCAGTT<br>GCTTTTATGATGTTGGTTGCATCTGGTGGATGGGTCCTAGAGTTCTCTAGGGGGTGC<br>CGCCCGAAGGGCCCGAGGGCAGAACTCCAGAAGCAGAAAAACTGGGGTTGTGGTG<br>TGTAGTCTCTAGGGCCTAGGTGGGAGAGGGTGGGAAGGGGAAATAAGGGAGACCT<br>TAATGTGCTGCAGGGAGGTACAAAGGGTTTGAGAAGGCTTATCAGGGAGTTGTCAG<br>ACCTGGTGGTGAAGGGCTCAGCATATGCAAACAGGGAAAGGCATGGTGTGAAGGG<br>CTTTCTGGGTTTGTGGTTCCCTGGCACACATCTGGTATAAGATGCTGCTAGGGAAAG<br>TAGACTGTGGGTCCATGGATTATAAGTGATGA (SEQ ID NO: 310) | 2541 |
| pARBI-706:<br>TRIM28_3_<br>Exogenous_<br>87 | GGCGCCCAATGCGCGTGCGCGGCGGCGTCGGCGCCAGTTATTTCTGTCCCGCCCCCC<br>GGCCTCGGCTCTTTCTGCGAGCGGGCGCGCGGGCGAGCGGTTGTGCTTGTGCTTGT<br>GGCGCGTGGTGCGGGTTTCGGCGGCGGCTGAGGAAGAAGCGCGGGCGGCGCCTTC<br>GGGAGGCGAGCAGGCAGCAGTTGGCCGTGCCGTAGCAGCGTCCCGCGCGCGGCGG<br>GCAGCGGCCCAGGAGGCGCGTGGCGGCGCTCGGCCTCGCGGCGGCGGCGGCGGC<br>AGCGGCCCAGCAGTTGGCGGCGAGCGCGTCTGCGCCTGCGCGGCGGGCCCCGCGC<br>CCCTCCTCCCCCCTGGGCGCCCCCGGCGGCGTGTGAATGGCGGCCTCCGCGGCGG<br>CAGCCTCGGCAGCAGCGGCCTCGGCCGCCTCTGGCAGCCCGGGCCCGGGCGAGGG<br>CTCCGCTTgacgactgtgccttctagttgccagccatctgttgtttgccctccccgtgccttccttgaccctg<br>gaaggtgccactcccactgtcctttcctaataaaatgaggaaattgcatcgcattgtctgagtaggtgtcattct<br>attctgggggtggggtggggcaggacagcaaggggaggattgggaagacaatagcaggcatgctgggga<br>tgcggtgggctctatggGGATCTGCGATCGCTCCGGTGCCCGTCAGTGGGCAGAGCGCAC<br>ATCGCCCACAGTCCCCGAGAAGTTGGGGGGAGGGGTCGGCAATTGAACGGGTGCC<br>TAGAGAAGGTGGCGCGGGGTAAACTGGGAAAGTGATGTCGTGTACTGGCTCCGCC | 2541 |

TABLE 5-continued

CONSTRUCTS USED FOR EVALUATION OF PREDICTED LOCI

| Construct name | Sequence | Length |
|---|---|---|
| | TTTTTCCCGAGGGTGGGGGAGAACCGTATATAAGTGCAGTAGTCGCCGTGAACGTT<br>CTTTTTCGCAACGGGTTTGCCGCCAGAACACAGCTGAAGCTTCGAGGGGCTCGCATC<br>TCTCCTTCACGCGCCCGCCGCCCTACCTGAGGCCGCCATCCACGCCGGTTGAGTCGC<br>GTTCTGCCGCCTCCCGCCTGTGGTGCCTCCTGAACTGCGTCCGCCGTCTAGGTAAGT<br>TTAAAGCTCAGGTCGAGACCGGGCCTTTGTCCGGCGCTCCCTTGGAGCCTACCTAGA<br>CTCAGCCGGCTCTCCACGCTTTGCCTGACCCTGCTTGCTCAACTCTACGTCTTTGTTTC<br>GTTTTCTGTTCTGCGCCGTTACAGATCCAAGCTGTGACCGGCGCCTACTCTAGAGCTA<br>GCGAATTgccgccaccATGGTGAGCAAGGGCGAGGAGCTGTTCACCGGGGTGGTGCC<br>CATCCTGGTCGAGCTGGACGGCGACGTAAACGGCCACAAGTTCAGCGTGTCCGGCG<br>AGGGCGAGGGCGATGCCACCTACGGCAAGCTGACCCTGAAGTTCATCTGCACCACC<br>GGCAAGCTGCCCGTGCCCTGGCCCACCCTCGTGACCACCCTGACCTACGGCGTGCAG<br>TGCTTCAGCCGCTACCCCGACCACATGAAGCAGCACGACTTCTTCAAGTCCGCCATG<br>CCCGAAGGCTACGTCCAGGAGCGCACCATCTTCTTCAAGGACGACGGCAACTACAA<br>GACCCGCGCCGAGGTGAAGTTCGAGGGCGACACCCTGGTGAACCGCATCGAGCTG<br>AAGGGCATCGACTTCAAGGAGGACGGCAACATCCTGGGGCACAAGCTGGAGTACA<br>ACTACAACAGCCACAACGTCTATATCATGGCCGACAAGCAGAAGAACGGCATCAAG<br>GTGAACTTCAAGATCCGCCACAACATCGAGGACGGCAGCGTGCAGCTCGCCGACCA<br>CTACCAGCAGAACACCCCCATCGGCGACGGCCCCGTGCTGCTGCCCGACAACCACTA<br>CCTGAGCACCCAGTCCAAGCTGAGCAAAGACCCCAACGAGAAGCGCGATCACATGG<br>TCCTGCTGGAGTTCGTGACCGCCGCCGGGATCACTCTCGGCATGGACGAGCTGTAC<br>AAatgattgtttattgcagcttataatggttacaaataaagcaatagcatcacaaatttcacaaataaagcatt<br>tttttcactgcattctagttgtggtttgtccaaactcatcaatgtatcttatGGCGGCGAAAAGCGCTCCA<br>CCGCCCCTTCGGCCGCAGCCTCGGCCTCTGCCTCAGCCGCGGCGTCGTCGCCCGCGG<br>GGGGCGGCGCCGAGGCGCTGGAGCTGCTGGAGCACTGCGGCGTGTGCAGAGAGC<br>GCCTGCGACCCGAGAGGGAGCCCCGCCTGCTGCCCTGTTTGCACTCGGCCTGTAGT<br>GCCTGCTTAGGGCCCGCGGCCCCGCCGCCGCCAACAGCTCGGGGGACGGCGGGG<br>CGGCGGGCGACGGCACCGGTAAGTACGAAGTGATCGGTGCCACCCCTCCCCCTACT<br>CTCTGCCTTTGATTCCGACTGGGTGCAGAGATGAGGATGCCACCTGGGCGAGAGGA<br>TGGGGGCCCGGACAGGGCACGGGAAATACTTTCTGGGTCCTGCATACGAACGTGG<br>GTTTGTGCTGGCCGCTGAGATGGGACATCTGACTAAAGTTGG (SEQ ID NO: 311) | |

SEQUENCE LISTING (331 sequences)

SEQ ID NO: 1 - DNA, 20 bp, Artificial Sequence
  Description of Artificial Sequence: Synthetic oligonucleotide
gcacctgaataccacgcctg

SEQ ID NO: 2 - DNA, 20 bp, Artificial Sequence
  Description of Artificial Sequence: Synthetic oligonucleotide
cgcctgcgatgtagtcgatg

SEQ ID NO: 3 - DNA, 20 bp, Artificial Sequence
  Description of Artificial Sequence: Synthetic oligonucleotide
caggacgggcgagatgtccc

SEQ ID NO: 4 - DNA, 20 bp, Artificial Sequence
  Description of Artificial Sequence: Synthetic oligonucleotide
ctgaatctttggagtacctg

SEQ ID NO: 5 - DNA, 20 bp, Artificial Sequence
  Description of Artificial Sequence: Synthetic oligonucleotide
ggccacggagcgagacatct

SEQ ID NO: 6 - DNA, 20 bp, Artificial Sequence
  Description of Artificial Sequence: Synthetic oligonucleotide
aagtcaacttcaatgtcgga

SEQ ID NO: 7 - DNA, 20 bp, Artificial Sequence
  Description of Artificial Sequence: Synthetic oligonucleotide
gcttggaggcctgatcagcg

SEQ ID NO: 8 - DNA, 20 bp, Artificial Sequence
  Description of Artificial Sequence: Synthetic oligonucleotide
cttatctcttcgcagcgagg

SEQ ID NO: 9 - DNA, 20 bp, Artificial Sequence
  Description of Artificial Sequence: Synthetic oligonucleotide
cacacattactccaacattg

SEQ ID NO: 10 - DNA, 20 bp, Artificial Sequence
  Description of Artificial Sequence: Synthetic oligonucleotide
ttccgcaaaatagagcccca

SEQ ID NO: 11 - DNA, 20 bp, Artificial Sequence
  Description of Artificial Sequence: Synthetic oligonucleotide
tgcacagaactatcgtacca

SEQ ID NO: 12 - DNA, 20 bp, Artificial Sequence
  Description of Artificial Sequence: Synthetic oligonucleotide
gcaataagactctttaaaga

SEQ ID NO: 13 - DNA, 20 bp, Artificial Sequence
  Description of Artificial Sequence: Synthetic oligonucleotide
caaagagattacgaatgcct

SEQ ID NO: 14 - DNA, 20 bp, Artificial Sequence
  Description of Artificial Sequence: Synthetic oligonucleotide
caaggcaccccaggtttcca

SEQ ID NO: 15 - DNA, 20 bp, Artificial Sequence
  Description of Artificial Sequence: Synthetic oligonucleotide
ttacgaatgccttggaaacc

SEQ ID NO: 16 - DNA, 20 bp, Artificial Sequence
  Description of Artificial Sequence: Synthetic oligonucleotide
cagagacgcatctgaccctc

SEQ ID NO: 17 - DNA, 20 bp, Artificial Sequence
  Description of Artificial Sequence: Synthetic oligonucleotide
catgcagttctcacacactg

SEQ ID NO: 18 - DNA, 20 bp, Artificial Sequence
  Description of Artificial Sequence: Synthetic oligonucleotide
gtgtgagaactgcatggaga

SEQ ID NO: 19 - DNA, 20 bp, Artificial Sequence
  Description of Artificial Sequence: Synthetic oligonucleotide
tctcatttcaggaaaccact

SEQ ID NO: 20 - DNA, 20 bp, Artificial Sequence
  Description of Artificial Sequence: Synthetic oligonucleotide
agtcatacaccttaaccaag

SEQ ID NO: 21 - DNA, 20 bp, Artificial Sequence
  Description of Artificial Sequence: Synthetic oligonucleotide
ttcaaggaaaccagttgagg

SEQ ID NO: 22 - DNA, 20 bp, Artificial Sequence
  Description of Artificial Sequence: Synthetic oligonucleotide
gagccttgcctggaaatctg

SEQ ID NO: 23 - DNA, 20 bp, Artificial Sequence
  Description of Artificial Sequence: Synthetic oligonucleotide
aagcgtcaaaagtctgccag

SEQ ID NO: 24 - DNA, 20 bp, Artificial Sequence
  Description of Artificial Sequence: Synthetic oligonucleotide
cgttccaactcgaagtgcca

SEQ ID NO: 25 - DNA, 20 bp, Artificial Sequence
  Description of Artificial Sequence: Synthetic oligonucleotide
gagcgactgggacacggtga

SEQ ID NO: 26 - DNA, 20 bp, Artificial Sequence
  Description of Artificial Sequence: Synthetic oligonucleotide
gctgcgcaagaagggcccta

SEQ ID NO: 27 - DNA, 20 bp, Artificial Sequence
  Description of Artificial Sequence: Synthetic oligonucleotide
ttgttctggccagcagcccc

SEQ ID NO: 28 - DNA, 20 bp, Artificial Sequence
  Description of Artificial Sequence: Synthetic oligonucleotide
cttccagagccacatcatcg

SEQ ID NO: 29 - DNA, 20 bp, Artificial Sequence
  Description of Artificial Sequence: Synthetic oligonucleotide
gggactcaccagagagaggt

SEQ ID NO: 30 - DNA, 20 bp, Artificial Sequence
  Description of Artificial Sequence: Synthetic oligonucleotide
cggtcgaaatagaagcccta

SEQ ID NO: 31 - DNA, 20 bp, Artificial Sequence
  Description of Artificial Sequence: Synthetic oligonucleotide
aaaaggatattgtgcaactg

SEQ ID NO: 32 - DNA, 20 bp, Artificial Sequence
  Description of Artificial Sequence: Synthetic oligonucleotide
tgtgcatatttattacatcg

SEQ ID NO: 33 - DNA, 20 bp, Artificial Sequence
  Description of Artificial Sequence: Synthetic oligonucleotide
tttgtgaagatcttgaccaa

SEQ ID NO: 34 - DNA, 20 bp, Artificial Sequence
  Description of Artificial Sequence: Synthetic oligonucleotide
tgtcatgctgaaccgcattg

SEQ ID NO: 35 - DNA, 20 bp, Artificial Sequence
  Description of Artificial Sequence: Synthetic oligonucleotide
ccactctatgaggatagtca

SEQ ID NO: 36 - DNA, 20 bp, Artificial Sequence
  Description of Artificial Sequence: Synthetic oligonucleotide
ttgacatagaagaggcacaa

SEQ ID NO: 37 - DNA, 20 bp, Artificial Sequence
  Description of Artificial Sequence: Synthetic oligonucleotide
gagtactacactcagcagca

SEQ ID NO: 38 - DNA, 20 bp, Artificial Sequence
  Description of Artificial Sequence: Synthetic oligonucleotide
tcacgcacaagaaacgtcca

SEQ ID NO: 39 - DNA, 20 bp, Artificial Sequence
  Description of Artificial Sequence: Synthetic oligonucleotide
aggtctcggtgaaaccacct

SEQ ID NO: 40 - DNA, 20 bp, Artificial Sequence
  Description of Artificial Sequence: Synthetic oligonucleotide
agcattatccaaagagtccg

SEQ ID NO: 41 - DNA, 20 bp, Artificial Sequence
  Description of Artificial Sequence: Synthetic oligonucleotide
atattaattcttaccagtgg

SEQ ID NO: 42 - DNA, 20 bp, Artificial Sequence
  Description of Artificial Sequence: Synthetic oligonucleotide
agctttaaatcaaggttcat

SEQ ID NO: 43 - DNA, 20 bp, Artificial Sequence
  Description of Artificial Sequence: Synthetic oligonucleotide
atcccgagccctaaggtgca

SEQ ID NO: 44 - DNA, 20 bp, Artificial Sequence
  Description of Artificial Sequence: Synthetic oligonucleotide
ggcagcgcggaggacagcgt

SEQ ID NO: 45 - DNA, 20 bp, Artificial Sequence
  Description of Artificial Sequence: Synthetic oligonucleotide
ctcagggggctactaccacc

SEQ ID NO: 46 - DNA, 20 bp, Artificial Sequence
  Description of Artificial Sequence: Synthetic oligonucleotide
gtcaccgacgagaccagaag

SEQ ID NO: 47 - DNA, 20 bp, Artificial Sequence
  Description of Artificial Sequence: Synthetic oligonucleotide
gtcgtggacttcgtactgct

SEQ ID NO: 48 - DNA, 20 bp, Artificial Sequence
  Description of Artificial Sequence: Synthetic oligonucleotide
taatttttaggcaagtgtcg

SEQ ID NO: 49 - DNA, 20 bp, Artificial Sequence
  Description of Artificial Sequence: Synthetic oligonucleotide
ttagctgttagacttgaata

SEQ ID NO: 50 - DNA, 20 bp, Artificial Sequence
  Description of Artificial Sequence: Synthetic oligonucleotide
cgagagccgtcaacttgcgt

SEQ ID NO: 51 - DNA, 20 bp, Artificial Sequence
  Description of Artificial Sequence: Synthetic oligonucleotide
cggcttcaactgcaaaggtg

SEQ ID NO: 52 - DNA, 20 bp, Artificial Sequence
  Description of Artificial Sequence: Synthetic oligonucleotide
tatgaaaaagcagagcgact

SEQ ID NO: 53 - DNA, 20 bp, Artificial Sequence
  Description of Artificial Sequence: Synthetic oligonucleotide
tctggcgggcgagctcacgc

SEQ ID NO: 54 - DNA, 20 bp, Artificial Sequence
  Description of Artificial Sequence: Synthetic oligonucleotide
ctcacgctggttaccgccta

SEQ ID NO: 55 - DNA, 20 bp, Artificial Sequence
  Description of Artificial Sequence: Synthetic oligonucleotide
aaagattacgaacttccctg

SEQ ID NO: 56 - DNA, 20 bp, Artificial Sequence
  Description of Artificial Sequence: Synthetic oligonucleotide
gttaaaaacagacatgccta

SEQ ID NO: 57 - DNA, 20 bp, Artificial Sequence
  Description of Artificial Sequence: Synthetic oligonucleotide
atgcctaaggaggttgtacc

SEQ ID NO: 58 - DNA, 20 bp, Artificial Sequence
  Description of Artificial Sequence: Synthetic oligonucleotide
ctccaggtatcccatcgaaa

SEQ ID NO: 59 - DNA, 20 bp, Artificial Sequence
  Description of Artificial Sequence: Synthetic oligonucleotide
caccaaatacgatagatcag

SEQ ID NO: 60 - DNA, 20 bp, Artificial Sequence
  Description of Artificial Sequence: Synthetic oligonucleotide
tggcggcgtgaatggcaaga

SEQ ID NO: 61 - DNA, 20 bp, Artificial Sequence
  Description of Artificial Sequence: Synthetic oligonucleotide
taggatggtagcacacaacc

SEQ ID NO: 62 - DNA, 20 bp, Artificial Sequence
  Description of Artificial Sequence: Synthetic oligonucleotide
cagcagcagagccccgacgg

SEQ ID NO: 63 - DNA, 20 bp, Artificial Sequence
  Description of Artificial Sequence: Synthetic oligonucleotide
cggcgtgcgaacggaatgtg

SEQ ID NO: 64 - DNA, 20 bp, Artificial Sequence
  Description of Artificial Sequence: Synthetic oligonucleotide
tatagacgctgcccgacgtc

SEQ ID NO: 65 - DNA, 20 bp, Artificial Sequence
  Description of Artificial Sequence: Synthetic oligonucleotide
tccaaagaagggtactgtgg

SEQ ID NO: 66 - DNA, 20 bp, Artificial Sequence
  Description of Artificial Sequence: Synthetic oligonucleotide
acagtacccttctttggaat

SEQ ID NO: 67 - DNA, 20 bp, Artificial Sequence
  Description of Artificial Sequence: Synthetic oligonucleotide
gcgacgggcgcatctacgtg

SEQ ID NO: 68 - DNA, 20 bp, Artificial Sequence
  Description of Artificial Sequence: Synthetic oligonucleotide
cccgacctccataagtcctg

SEQ ID NO: 69 - DNA, 20 bp, Artificial Sequence
  Description of Artificial Sequence: Synthetic oligonucleotide
ggggtcctcgaagcgcacga

SEQ ID NO: 70 - DNA, 20 bp, Artificial Sequence
  Description of Artificial Sequence: Synthetic oligonucleotide
tgctctgtttagaagatgac

SEQ ID NO: 71 - DNA, 20 bp, Artificial Sequence
  Description of Artificial Sequence: Synthetic oligonucleotide
atattcttttctagttaaag

SEQ ID NO: 72 - DNA, 20 bp, Artificial Sequence
  Description of Artificial Sequence: Synthetic oligonucleotide
cctgtaaagaaacaaaagac

SEQ ID NO: 73 - DNA, 20 bp, Artificial Sequence
  Description of Artificial Sequence: Synthetic oligonucleotide
tggagaaagacgtaacttcg

SEQ ID NO: 74 - DNA, 20 bp, Artificial Sequence
  Description of Artificial Sequence: Synthetic oligonucleotide
tctgccctgaggtatgcgat

SEQ ID NO: 75 - DNA, 20 bp, Artificial Sequence
  Description of Artificial Sequence: Synthetic oligonucleotide
attccgcttggtgaaaacga

SEQ ID NO: 76 - DNA, 20 bp, Artificial Sequence
  Description of Artificial Sequence: Synthetic oligonucleotide
caggcacaatagaaacaacg

SEQ ID NO: 77 - DNA, 20 bp, Artificial Sequence
  Description of Artificial Sequence: Synthetic oligonucleotide
ccatttgtaatgctgacttg

SEQ ID NO: 78 - DNA, 20 bp, Artificial Sequence
  Description of Artificial Sequence: Synthetic oligonucleotide
ctgggtcacttgtgccgtgg

SEQ ID NO: 79 - DNA, 20 bp, Artificial Sequence
  Description of Artificial Sequence: Synthetic oligonucleotide
gtcagggttctggatatctg

SEQ ID NO: 80 - DNA, 20 bp, Artificial Sequence
  Description of Artificial Sequence: Synthetic oligonucleotide
tggatttagagtctctcagc

SEQ ID NO: 81 - DNA, 20 bp, Artificial Sequence
  Description of Artificial Sequence: Synthetic oligonucleotide
ctgcggctgtggtccagctg

SEQ ID NO: 82 - DNA, 20 bp, Artificial Sequence
  Description of Artificial Sequence: Synthetic oligonucleotide
acaaaactgtgctagacatg

SEQ ID NO: 83 - DNA, 20 bp, Artificial Sequence
  Description of Artificial Sequence: Synthetic oligonucleotide
ttcttccccagcccaggtaa

SEQ ID NO: 84 - DNA, 20 bp, Artificial Sequence
  Description of Artificial Sequence: Synthetic oligonucleotide
cgtcatgagcagattaaacc

SEQ ID NO: 85 - DNA, 20 bp, Artificial Sequence
  Description of Artificial Sequence: Synthetic oligonucleotide
gagagcgcctgcgacccgag

SEQ ID NO: 86 - DNA, 20 bp, Artificial Sequence
  Description of Artificial Sequence: Synthetic oligonucleotide
ccagcgggtgaagtacacca

SEQ ID NO: 87 - DNA, 20 bp, Artificial Sequence
  Description of Artificial Sequence: Synthetic oligonucleotide
ggagcgcttttcgccgccag

SEQ ID NO: 88 - DNA, 20 bp, Artificial Sequence
  Description of Artificial Sequence: Synthetic oligonucleotide
tgaggcctggaccttatgca

SEQ ID NO: 89 - DNA, 20 bp, Artificial Sequence
  Description of Artificial Sequence: Synthetic oligonucleotide
cctggtggagtgaaccatga

SEQ ID NO: 90 - DNA, 20 bp, Artificial Sequence
  Description of Artificial Sequence: Synthetic oligonucleotide
caagcacttaggttcccctg

SEQ ID NO: 91 - DNA, 20 bp, Artificial Sequence
  Description of Artificial Sequence: Synthetic oligonucleotide
ggtctccctacaattcagcg

SEQ ID NO: 92 - DNA, 20 bp, Artificial Sequence
  Description of Artificial Sequence: Synthetic oligonucleotide
cacagcgcgtgactgcaatg

SEQ ID NO: 93 - DNA, 20 bp, Artificial Sequence
  Description of Artificial Sequence: Synthetic oligonucleotide
tctggggcaccaattctagg

SEQ ID NO: 94 - DNA, 20 bp, Artificial Sequence
  Description of Artificial Sequence: Synthetic oligonucleotide
gagccatgcttggcttacga

SEQ ID NO: 95 - DNA, 20 bp, Artificial Sequence
  Description of Artificial Sequence: Synthetic oligonucleotide
gtacaagtacttatctcatg

SEQ ID NO: 96 - DNA, 20 bp, Artificial Sequence
  Description of Artificial Sequence: Synthetic oligonucleotide
gagataacaacataacaaca

SEQ ID NO: 97 - DNA, 20 bp, Artificial Sequence
  Description of Artificial Sequence: Synthetic oligonucleotide
catattccatagtctttggg

SEQ ID NO: 98 - DNA, 20 bp, Artificial Sequence
  Description of Artificial Sequence: Synthetic oligonucleotide
ctgccccttagcaacttagg

SEQ ID NO: 99 - DNA, 20 bp, Artificial Sequence
  Description of Artificial Sequence: Synthetic oligonucleotide
tgtttaaaaatatgttgaca

SEQ ID NO: 100 - DNA, 20 bp, Artificial Sequence
  Description of Artificial Sequence: Synthetic oligonucleotide
ccaggaatggaaactcacgc

SEQ ID NO: 101 - DNA, 20 bp, Artificial Sequence
  Description of Artificial Sequence: Synthetic oligonucleotide
gaggccgctgaattaacccg

SEQ ID NO: 102 - DNA, 20 bp, Artificial Sequence
  Description of Artificial Sequence: Synthetic oligonucleotide
atacacgcacacttgcagaa

SEQ ID NO: 103 - DNA, 20 bp, Artificial Sequence
  Description of Artificial Sequence: Synthetic oligonucleotide
gagcagacagaaacccaggg

SEQ ID NO: 104 - DNA, 20 bp, Artificial Sequence
  Description of Artificial Sequence: Synthetic oligonucleotide
tgagtctccaaacagaacag

SEQ ID NO: 105 - DNA, 20 bp, Artificial Sequence
  Description of Artificial Sequence: Synthetic oligonucleotide
taatatcactgacttcacgg

SEQ ID NO: 106 - DNA, 20 bp, Artificial Sequence
  Description of Artificial Sequence: Synthetic oligonucleotide
tacacacaatgtaagcagca

SEQ ID NO: 107 - DNA, 20 bp, Artificial Sequence
  Description of Artificial Sequence: Synthetic oligonucleotide
gggagctcaattcgaaacca

SEQ ID NO: 108 - DNA, 20 bp, Artificial Sequence
  Description of Artificial Sequence: Synthetic oligonucleotide
ttggacaggtgagacagtcg

SEQ ID NO: 109 - DNA, 20 bp, Artificial Sequence
  Description of Artificial Sequence: Synthetic oligonucleotide
aagctcactcagatagtgtg

SEQ ID NO: 110 - DNA, 20 bp, Artificial Sequence
  Description of Artificial Sequence: Synthetic oligonucleotide
caggagaaccaccttacacg

SEQ ID NO: 111 - DNA, 20 bp, Artificial Sequence
  Description of Artificial Sequence: Synthetic oligonucleotide
ggacagaccctgattcacaa

SEQ ID NO: 112 - DNA, 20 bp, Artificial Sequence
  Description of Artificial Sequence: Synthetic oligonucleotide
acatggcagtctatgaacag

SEQ ID NO: 113 - DNA, 20 bp, Artificial Sequence
  Description of Artificial Sequence: Synthetic oligonucleotide
cctatagagagtactacttg

SEQ ID NO: 114 - DNA, 20 bp, Artificial Sequence
  Description of Artificial Sequence: Synthetic oligonucleotide
ccaaccgggtcttcattacg

SEQ ID NO: 115 - DNA, 20 bp, Artificial Sequence
  Description of Artificial Sequence: Synthetic oligonucleotide
tcaagcgtagagttccgagt

SEQ ID NO: 116 - DNA, 20 bp, Artificial Sequence
  Description of Artificial Sequence: Synthetic oligonucleotide
tcatgcaattatggacccag

SEQ ID NO: 117 - DNA, 20 bp, Artificial Sequence
  Description of Artificial Sequence: Synthetic oligonucleotide
cgggaaagtgactggccatg

SEQ ID NO: 118 - DNA, 20 bp, Artificial Sequence
  Description of Artificial Sequence: Synthetic oligonucleotide
tgagattgaaatcaaatcgg

SEQ ID NO: 119 - DNA, 20 bp, Artificial Sequence
  Description of Artificial Sequence: Synthetic oligonucleotide
tatgcaatattcatcacgcg

SEQ ID NO: 120 - DNA, 20 bp, Artificial Sequence
  Description of Artificial Sequence: Synthetic oligonucleotide
aatgtgttaaatcaaatgca

SEQ ID NO: 121 - DNA, 103 bp, Artificial Sequence
  Description of Artificial Sequence: Synthetic polynucleotide
ggggccactagggacaggatgttttagagctagaaatagcaagttaaaataaggctagtccgttatcaacttgaaaaagtggcaccgagtcggtgcttttttt

SEQ ID NO: 122 - DNA, 20 bp, Homo sapiens
ggggccactagggacaggat

SEQ ID NO: 123 - DNA, 1806 bp, Artificial Sequence
  Description of Artificial Sequence: Synthetic polynucleotide
atctcggccaataaaggagaaagggcgcggcccgtacgcgcgccaggtgcgtgggcgagaccagctcacgcccctcctccagccgccaaggccccggcccacagctgcctggctgcagtcagaagcgtagcccgagacaaggaagggcgccttgactcgcacttttgtccggttcgaacgttctgctcagtggtgcgtggaatgcgagcgcgtcttaaaatcgatggcgcctaggagtccatgaaatacggtacaggcttccggcgacggatgccccgcccctcacccacgctccgccctccggggatgccccacccctcgtggcggtcccgcccgtccccgcgcaggcgcgctcgggctgccgctggctcttcgcacgcggccatggccgactccgagctgcagctggttgagcagcggatccgcagcttccccgacttccccaccccatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagccc

SEQ ID NO: 124 - DNA, 1806 bp, Artificial Sequence
  Description of Artificial Sequence: Synthetic polynucleotide
tgccccgcccctcacccacgctccgccctccggggatgccccacccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttccttctgcgagctggtattgagcgcctgccacgagccaggccttccctggtgaagatcacggaatgcccacccagggaagggaggcctggaggcctccgggagagcccaagaggtggcccagggaga

SEQ ID NO: 125 - DNA, 1806 bp, Artificial Sequence
  Description of Artificial Sequence: Synthetic polynucleotide
cgttctgctcagtggtgcgtggaatgcgagcgcgtcttaaaatcgatggcgcctaggagtccatgaaatacggtacaggcttccggcgacggatgccccgcccctcacccacgctccgccctccggggatgccccacccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccaggtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttccttctgcgagctggtattgagcgcctgccacga

SEQ ID NO: 126 - DNA, 1806 bp, Artificial Sequence
  Description of Artificial Sequence: Synthetic polynucleotide
agtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggttccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcaga

SEQ ID NO: 127 - DNA, 1806 bp, Artificial Sequence
  Description of Artificial Sequence: Synthetic polynucleotide
aagatcttaatcttctgggtttccgttttctcgaatgaaaaatgcaggtccgagcagttaactggctggggcaccattagcaagtcacttagcatctctggggccagtctgcaaagcgagggggcagccttaatgtgcctccagcctgaagtcctagaatgagcgcccggtgtcccaagctggggcgcgcaccccagatcggagggcgccgatgtacagacagcaaactcacccagtctagtgcatgccttcttaaacatcacgagactctaagaaaaggaaactgaaaacgggaaagtccctctctctaacctggcactgcgtcgctggcttggagacaggtgacggtccctgcgggccttgtcctgattggctgggcacgcgtttaatataagtggaggcgtcgcgctggcgggcattcctgaagctgacagcattcgggccgagatgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcg

SEQ ID NO: 128 - DNA, 1806 bp, Artificial Sequence
  Description of Artificial Sequence: Synthetic polynucleotide
aggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatcctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttg

SEQ ID NO: 129 - DNA, 1806 bp, Artificial Sequence
  Description of Artificial Sequence: Synthetic polynucleotide
gatctcacattctagcgcccagacatgtcgggaacgccttacgccaacttggggtccccaccaagagaacccccaccagatctgcaccctccccttcacgcgtgcacccagtccaggctccctcaagccccacgggtgccttttagacctgaggaggttgcaaacctgatcccccatacctgccccacccatccgcggacaacccgccctcgcaaactcagacccccacccggaggcttcagattcctcccaggtccagctgccggaaatgcgtgtttgaagggagggtgtgggctcaggggcgaagcacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatagcggggccgggggcggcggcggcggcggcggcggcggcggcggtggtggaggcggcggtggcggtggaacggccatgcgcatcctaggcggagtcatcagcgccatcaggtaaggcggagactatcagaggggcggggcctgggaatgggaggagcctcagtgaggcgtggtctgggaggggcgtggtctaaaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgtt

SEQ ID NO: 130 - DNA, 1806 bp, Artificial Sequence
  Description of Artificial Sequence: Synthetic polynucleotide
cgggcatttaggaagcgggccatggagtagggtcttgggcagatggcacctgaggaggataaggccttgggaagctggggcagagcctctatgaagtgagccctccaaggggcggggtcttttgattctacgtgggattttttaggtttagggtggccaagatgactgaaatctgccactgggtaggtgtgcctggcaggaggggagcctcccaggggaccggtctctgggtttcctcgagggtggggttggcctgaggaagggagaagaggggcacgaccagggcagtgtggattgggacagatgaggacaagaacaaatgaaaggcacagcaaccaagtaaggaagataacggctggggtctggagcgttggggctgatggttctgtagtgctgcccgttggaggccccgcccctggcactaacccctcccccttatctcttcgcagctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgaggcggctgcgcagtacaacccggagcccccggtaagccccctctgcaaccagacccccttctcctgccaaggcctcttcgaggtcccatccctgttcctgtagagaagccccaccttcctccccttcttgtgaaattcctctgccagttcctcccatgccgtgtctgcagcttcgccatgggtcttagccatgccccacatacgtgcaccccattcactaccacccctcattcttttcctcatcaagctgcccagcccactctgacttccccacccagggtacctgggtttggggagccgtcctggccgggttcccctccccctgctctgagctctcctccctttgcagcccccacgcacacattactccaacattgaggccaacgagagtgaggaggtccggcagttccggagactctttgcccagctggctggagatgtaagtaac

SEQ ID NO: 131 - DNA, 1806 bp, Artificial Sequence
  Description of Artificial Sequence: Synthetic polynucleotide
gctgatggttctgtagtgctgcccgttggaggccccgcccctggcactaacccctcccccttatctcttcgcagcgaggcggctgcgcagtacaacccggagcccccggtaagccccctctgcaaccagacccccttctcctgccaaggcctcttcgaggtcccatccctgttcctgtagagaagccccaccttcctccccttcttgtgaaattcctctgccagttcctcccatgccgtgtctgcagcttcgccatgggtcttagccatgccccacatacgtgcaccccattcactaccacccctcattcttttcctcatcaagctgcccagcccactctgacttccccacccagggtacctgggtttggggagccgtcctggccgggttcccctccccctgctctgagctctcctccctttgcagcccccacgcacacattactccaactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatattgaggccaacgagagtgaggaggtccggcagttccggagactctttgcccagctggctggagatgtaagtaacctggggtccctggccccgtcctaaccgttccatcccttcccttgtggctgcccttgcacacacacccttgaccatgacaatcccagtgttcccattctccatgacattctcagacccctttcagtcacccctgacctgcccctaacttccgcccgcaggacatggaggtcagcgccacagaactcatgaacattctcaataaggttgtgacacgacgtaagtgaccggggttaaggaatagggtagattcagaggcagaggggtcagagaggatttgacctctggcctctgactttcaacctgttacccacagaccctgatctgaagactgatggttttggcattgacacatgtcgcagcatggtggccgtgatg

SEQ ID NO: 132 - DNA, 1806 bp, Artificial Sequence
  Description of Artificial Sequence: Synthetic polynucleotide
ggagagttatagcagatggagacaaaaaagggaactgctggggatcaaaccttgtaaagtccttctaagtgatatatgaggactttgacttttattcaaagttagaaggctttgaacaaaagaattatttcatttgtgttttacaatggtcacaagtgccgtagcgagaataggctgtgtagagaagagattttgtggttttcttttttgttctctgtattctcttcctgaaaaatctgttttctgcctaatcatatttctgtaaagaacaatagacttgaacgtctgctgttaagtaacaaaggttgacctaaaccacataaggtcagattaacttttaaaatatccaagataatgttaagtgtattaaatatggttcagtatgtaatcaaaatatttgatattctctagatactaatctcttttaatttttttattttttagccttggtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggctctattttgcggaattggaatttcttagctgtgacacatccaggttacatggcatttctcacatatgatgaagttaaagcacgactacagaaatatagcaccaaacccggaaggtaagactttttagcagtaatattatgtgatatatccaaagatgaaaaattctccatggtttgttcctaagtaagtcagcaatacccgctgatggcatgcttgggagggggctagaaaaggtaaaagaccaaaatggtgcttcttaacataatgttttaaattgatacattgtgcttactctgaaacttggtattcataaagtgaaaggggatatggtctcctttctgttttcatgatatccgtgtttatgtgcaaaattgaatgtatatatttgaatacttgaatactgtgctaaagaacaaataaatagaacagtcttatgttcattacttt

SEQ ID NO: 133 - DNA, 1806 bp, Artificial Sequence
  Description of Artificial Sequence: Synthetic polynucleotide
catattactcatttgtgcaatgaataaaggatttctattattatatggacccatcatcttatgactgtttttagaaaatgagaattaaatcttgattcattattaaataaccttgtatacacacatgaagaggtcatgacacataagactttgacctaataccttttttcagatatgtttctatagctatcttgatagcctaggactgtttgagagaaaattaatttaaatttttgtcatattcttagcaaatgcaaaataattgagttaaacagaacccactacatttgttctgaaatatgaacaatattctcaaatatttgtctggtagtacaaatacaattatattaattttattattgaattttgctgcttcaaagggaggtatttcttaaatgatacttgattcaattatttccctttttttccaccttgcacagaactatcgtatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatccatggaaagtattcagacagtgccttcatgaggtccaccagattagctctggcctggaagcaatggctctaaaatcaacaattgatttaacttgcaatgattacatttcagtttttgaatttgatatttttaccaggctgtttcaggtaagtttatacttgcttagtctatccattcccttcttctctctccctgtcttttctctctgtttctctctctctctgtctctctctcacacacacacacataaacaaacatatggaaaatagtgtcattcctattagtctgtaattttattggtatgtttggtcattgttaaaagtttagagtgagccatttggcttaagtttggagttatcagatgctgtgagcctggtggctgcttgttagctttgagaggatccatccaaaagagctttgttttaaactctctacttagtttcttactt

SEQ ID NO: 134 - DNA, 1806 bp, Artificial Sequence
  Description of Artificial Sequence: Synthetic polynucleotide
ttaaactttagaggttcaaaataaggatatgatatagaaaagattgaatggtaggagaacagaataggatttatttatattatgacaaacgtgactatcagttaataaattggagatagtaagttaagatcattatttatattatggaaaaatgaagaaataggacatggttctctaactttttaatttttctgtgaaataaaatattatgacttattttatttttatctttgtttttaggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgaaggcaaggagagaatgtatgaagaacagtcacaggacaggtaagaagaatatttcagatgttttggtgtaaaggtcatttatgttgctttttacttaatagttaacctaaacgtcaccatgtaattgttttggggtaaatgtgagtcgctttgtatatagtcatgtggtacttaacgatggggatactttacaagaaatgcatttttagacaatttcattgttgtgtggacatgatagagtgtacttacacagagctagatggtattacctaccgcacacctaggctgtatgatgtagcctattgctcctaggctgcaaatctatacagtatgttactgtactgaatactgtgggcagttgtaacacaatggtaagtatgtgtgtatctaaatatacctaaacatagaaaaggtatggtaaaaatactgtataaaaggccgggcgtgg

SEQ ID NO: 135 - DNA, 1806 bp, Artificial Sequence
  Description of Artificial Sequence: Synthetic polynucleotide
agatgagaaaacctatccttcccaatttttttgtgtgagaattaaaatgcagcaagaaaacacacactcataaacacatctgctttggcaaaggagcacatcagaagggctggcttgtgcgcgctcttgctctctgtgtatgtgtattatgttttatgttactgtaaaagatgtaaagagaggcacgtggttaagctctcggggtgtggactccaccagtctcacttcagttccttttgcatgaagagctcagaatcaaaagaggaaaccaacccctaagatgagctttccatgtaaatttgtagccagcttccttctgattttcaatgtttcttccaaaggtaagcataagagtcaaagaagtcccaacccagctttccctgaaagtgactctcagtaactcttttgctttttataggtgcagtctccaaagagattacgaatgccttgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaaggtaagtgttcattcccttaattgctttatttcagtgtgggtgctatttggcaagttggaaaatagcatttctaatattccccagcgctgacctctgcctccaggggggctatacaggaaaccagatgcatgtctcctgccccagtggagactgtggtccaa

SEQ ID NO: 136 - DNA, 1806 bp, Artificial Sequence
  Description of Artificial Sequence: Synthetic polynucleotide
aggattgttctagttgattggtatgtgtgcactcctagttgttaaatattttcactatcacacctggatatactcaacaaatatttgttgagccaaatactcaacaccagccaaacacgtagtatttactttagcttaagcgaattatttagccctgacagaagccctggaatgtgggtctttaagttcctatttttgagatgggaaagctgaggctcacggaaggaggtgaccagctcaagtctcctaccgtccatgccaaattagaattccagcctgcctcctgacttcaagtccaaagttcttcccacgcactaaagctagctcttcagtgtcctttcttaggaggtacttcctcccgcaccactgaccgccccctctctatttcacccccagcccatccggaaaggccagcgggacctgtattctggcctgaatcagagacgcatctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgtt

SEQ ID NO: 137 - DNA, 1806 bp, Artificial Sequence
  Description of Artificial Sequence: Synthetic polynucleotide
aataataaaataataacaatacttaacatttattgagtgcttattaagtctcaagcactgtctgtacccaacacttatcaaggattctttttcatgtaatcctctcaacaactatatgggttaagtatcattttattcccatgagtaaagggatgaggaaacagagggtttgtgagttgaaaacacatttcacgcttctcacagctagtgagtaataaagctgggactcaaacccagggctgtttgactccagtgcctctacccacggccaccactctttgcttgtcaatgttgttctaaacatattgaagggggggctctgaccgtggcaagcgtgtgagtagtaaggggagaatggccttcatgcactccctcctcacctccagcgccttgtgttttccttgcttagtgatttcccctctccccaccccaccccccacagtgtgtgagtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggtaaggctgtggagtccagtcagaggagattcctgccaagggggacgaccagcctgggccagggtgggtggcaagtccacagctaggtcagaacagcttctctagagcttctatgcacagcttctattactgtgatgacaagatctcaacagacggtttcaaatctcacatcactcccctccttcccatcctagaaaagtgcaaaaaagtttatgaaagtgatgggcttcctcacatacctgtcaatgcctgcagtcatccgattccgcccctaagctgtgggaagagag

SEQ ID NO: 138 - DNA, 1806 bp, Artificial Sequence
  Description of Artificial Sequence: Synthetic polynucleotide
actgtgacccatgaaccagtaggtattggcgtcacctgggatcctgacgttagtctctgtcaatccttctctttagttcatctattctacccaaagtgatctcatcatctggtatgctgttagcagtttcttacctgtatagtatcttccaaataacatgccccaaaatcccaaagttttacccctactaattacagcaatgtctcttttattcttcaccccctgacgcagatattggcgtcacccgagagcatgttagtaatgcagaatctcccctccccagaactactaaatagcacctgaaattttaacaagatccccatgtgattcatgtgcacatcaaagtttgagaaacactactctaatgatctcctggtatgcagaagcagggagaatttcagaggcaagatccttaatagaaccacggcttttctcatttcaggaaaccactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaagtatgtaatcccctttggtctgtttgttgtgaaattaatcagtatttgctgttctggtgagctttttatctggggtgaaagtggaaatagatcctcaacagtaatattatcgcctgttctcttaatttcagcttgcctcttttaaaatactgtaagatacttccctcaccctattgaaaaactacagccagtcctgtaaaattttgtttacctttgggtgggctccatgg

SEQ ID NO: 139 - DNA, 1806 bp, Artificial Sequence
  Description of Artificial Sequence: Synthetic polynucleotide
ttcgagacaagcctggccaacatgatgaaactctgtctctactaaaaatacaaaaaaaattaaccaggcgtggaggcgcgcgcctgtagtcccagctactcaggaggctgaggcaggaggaccacttgaacccaggaggtcgaggttgcagtgagctgcgattgtgccactgcactccagcctgggcaacagagaaagactccgtctcaaaaaaaaaaaagagagagagagaaaaagaaaaaagacagagcctccatctccttgtcctctttccatcctcaggaccatgaagtacccactccaaattctcacatataaaaaacattcaataaacatgcatcaaattaattaatagaggatggaaaaaatgacttatgactgtgctgtcctttccagcccctcaaggatcgagaagatgaccagtacagccaccttcaaggaaaccagttgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataggaggaattgaactcaggactcagagtaggtgggttcttcaatgccaattctaataaaggacccttgcatcaactgccctcgcaattgcttctaagtctagctcccttccctaagcggctataagcatcagactctggggatcagggattgggacgtggtttggggtactcttttctaaaaattctggggccatactgattgtcttggcctaggtaaatatgaattttatgtatctgtaaatcctgtcagagcagggcctcaagccatagagatgctgaatattaatcttaacctacatttgaatttctcattatctacactattaacattttgggctaattaattatttgtgatgaggggctagcctgtgcattgtaggagttatggaagcatccctggcctctctccaccagatgctggtagattgtccagtgtgacaatcaaaaat

SEQ ID NO: 140 - DNA, 1806 bp, Artificial Sequence
  Description of Artificial Sequence: Synthetic polynucleotide
gacctcaggtgatctgcccgcctcagcttcccaaagtgctgggattacaggcatgagccaccacacctggcctaaaattaatttttaaagatctcttaaaaagcagacaccagccccaatctcagaccccttgagacagaatttccaggacaggggccatcctgctggacagtgggtgccgagaacaccttgcccatttatctgagctcccttctgactctgaaatctggagccccaccctcctgggtctagcttcggggctgcctgggtcagggtcctctgggaagcccctgcagtgccccagaagggacgaagctcacaaggggcaaggcaggcagcccacggggcaggagggagctcaactgggcgtcctagggagagggcagtgaggggtgccagtggggaacccctcccagcctgacccccaccacacctttctgacccccagattccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttaggtgggtaactagccagccacacgggcaccctgggcctgggcgccagccccgaggagactgcccgaggcctgtgatctagggtctgagcaggctggtggaaggggtggggggaccccagtttataaccactccccaagacacatacc

SEQ ID NO: 141 - DNA, 1806 bp, Artificial Sequence
  Description of Artificial Sequence: Synthetic polynucleotide
ggacaggggccatcctgctggacagtgggtgccgagaacaccttgcccatttatctgagctcccttctgactctgaaatctggagccccaccctcctgggtctagcttcggggctgcctgggtcagggtcctctgggaagcccctgcagtgccccagaagggacgaagctcacaaggggcaaggcaggcagcccacggggcaggagggagctcaactgggcgtcctagggagagggcagtgaggggtgccagtggggaacccctcccagcctgacccccaccacacctttctgacccccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttaggtgggtaactagccagccacacgggcaccctgggcctgggcgccagccccgaggagactgcccgaggcctgtgatctagggtctgagcaggctggtggaaggggtggggggaccccagtttataaccactccccaagacacatacccaggagggggactggaaggggccagcacccatctgtaggatggcaatggaggacctagttctgccaatcactgacttcatcgtcgcctctgaacctccattctcccatctgtgaagtggggtggtacttcccgcctcgcaggaggct

SEQ ID NO: 142 - DNA, 1806 bp, Artificial Sequence
  Description of Artificial Sequence: Synthetic polynucleotide
tgctgggattacaggcatgagccaccacacctggcctaaaattaatttttaaagatctcttaaaaagcagacaccagccccaatctcagaccccttgagacagaatttccaggacaggggccatcctgctggacagtgggtgccgagaacaccttgcccatttatctgagctcccttctgactctgaaatctggagccccaccctcctgggtctagcttcggggctgcctgggtcagggtcctctgggaagcccctgcagtgccccagaagggacgaagctcacaaggggcaaggcaggcagcccacggggcaggagggagctcaactgggcgtcctagggagagggcagtgaggggtgccagtggggaacccctcccagcctgacccccaccacacctttctgacccccagatttccaggcaaggctcacccgttccaactcgaagtgctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttaggtgggtaactagccagccacacgggcaccctgggcctgggcgccagccccgaggagactgcccgaggcctgtgatctagggtctgagcaggctggtggaaggggtggggggaccccagtttataaccactccccaagacacatacccaggagggggactggaaggggccagcacccatctgt

SEQ ID NO: 143 - DNA, 1806 bp, Artificial Sequence
  Description of Artificial Sequence: Synthetic polynucleotide
gggggcggccgcacggctagagcggagaccccgcgccccctccgcccgcgtggcccggccggggtgcggggcccggggaggcacgggggctgcgcgtcggggcgcagccgccgcccgcgtgtgctcggaggccgcggggcccgggctccggggtcctcccgacctgcagccccagcggctaccgcgcctcgccaggccaggccaggccccgacgtcgccttccctacgtcgccggcgcccggccacgacgtccctcagacgagccgaacgccgaatggccccgagcacgggaagtgcccgccccccgcgtgcagccagccaatgggacgccgaaagcggggaggtgccgaggggacgtagcgtcgccgcgccaggtctctagcagctgccgctgagccgccggacggacgctcgtcttcgcccgccatggccgagagcgactgggacacgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtgacggtgctgcgcaagaagggccctacggccgcccaggccaaatccaagcaggtgctttgctgactgaggagcggccgggccgggcggggcggacgctgggccggggccacggaccgtggggcagggggctcggggaagggcaggcggggcctgggacagggcgcaggggacggggacaaggctggggtgccgggggcaggacggggttcgaagggcggggcgaatcgcaggggtaggaggaccgggccaggacaggggtgggaaggtggggggcggacccaggaggggatggacggacccaggaggcagggggcgggcgactggaggaggagaggagcagggaaccggacggggcaaggggcaggcgatagggccgggaccagtgccagggtggggcggggaggggataggggcagggactgttggtggggacaggtgtgaggacag

SEQ ID NO: 144 - DNA, 1806 bp, Artificial Sequence
  Description of Artificial Sequence: Synthetic polynucleotide
acggctagagcggagaccccgcgccccctccgcccgcgtggcccggccggggtgcggggcccggggaggcacgggggctgcgcgtcggggcgcagccgccgcccgcgtgtgctcggaggccgcggggcccgggctccggggtcctcccgacctgcagccccagcggctaccgcgcctcgccaggccaggccaggccccgacgtcgccttccctacgtcgccggcgcccggccacgacgtccctcagacgagccgaacgccgaatggccccgagcacgggaagtgcccgccccccgcgtgcagccagccaatgggacgccgaaagcggggaggtgccgaggggacgtagcgtcgccgcgccaggtctctagcagctgccgctgagccgccggacggacgctcgtcttcgcccgccatggccgagagcgactgggacacggtgacggtgctgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcgcaagaagggccctacggccgcccaggccaaatccaagcaggtgctttgctgactgaggagcggccgggccgggcggggcggacgctgggccggggccacggaccgtggggcagggggctcggggaagggcaggcggggcctgggacagggcgcaggggacggggacaaggctggggtgccgggggcaggacggggttcgaagggcggggcgaatcgcaggggtaggaggaccgggccaggacaggggtgggaaggtggggggcggacccaggaggggatggacggacccaggaggcagggggcgggcgactggaggaggagaggagcagggaaccggacggggcaaggggcaggcgatagggccgggaccagtgccagggtggggcggggaggggataggggcagggactgttggtggggacaggtgtgaggacagaggcaggaggtg

SEQ ID NO: 145 - DNA, 1806 bp, Artificial Sequence
  Description of Artificial Sequence: Synthetic polynucleotide
ccctggagtcggtgtgaggcaaaagcagaggagaggatttggaattaacctgaagaaaaaccatttcaaagcggtaaccagaccccagaggctgcctgaactcaaggggacatgggaacccaggctgtcccaagttcacacacctcaggtcgtggacttccagagttttctctcagttatgaggacaggcagctgtactcatgccaaccagagctgctctgggaagatggctgcctcccagggctccggccagcaccggtgcaggcaggcactcagctgacaacgtccccgggggcgccgcacacaccacacccaccagcacatggaccccacagcacagcctcatgttgcaagcggaaacacaagtacctacatttcttggaagtctccacatcttctcctcgtctctgtgccgctaagatagcctagaaaattagaaaacatcagtggtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattttctaaagagaagatgtgctttatacacatcagctccactaggactgctgcaaaaccaggcgcgaagcgtcgcctgagaacagcagcttctagggcccctggggtacgcacccacacgcagctgggttttgtgcgagaggcagtgagagccgggctgacctggcttcccgaggcattccctgcaggggaaccaggggggtggagcccaccctccccgtgctatctgaacaccggccatccccctccccaaacccacaaccccaggagtgagagccccggcgcagcctcaccgtggccaggtccttctgcgtaagccccttgctctgccgaccttgctggatcaccttgcccacctccagggtcaccctgtcatggtgcagctcctctgtctcccggtccagcttggccgtgttcttggtaatagaatgttgtttgttctggccagcagc

SEQ ID NO: 146 - DNA, 1806 bp, Artificial Sequence
  Description of Artificial Sequence: Synthetic polynucleotide
ctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctggtgagtccccaggacgcccctggccctaatttcctccagctgcgcacctccggccctcactgcacgcgccagccttctttgtgcggtcgggtaaacagagggcggagtccccttggcctcgcctcccgctaaccattgttgcctccatctcttcccgtagggcttctatttcgactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctggaaatagaggcgcacctcgtgcagtgcccacaacacgcggcagtccacaccgctgcgtggtcttagggacgtatagctgtaagagctaggacagggtgcggagagtgataaatacaagctgtcacatgtctttgtggcctgggcctctgacccccaacgactcttgggaaatgtaggtttagttct

SEQ ID NO: 147 - DNA, 1806 bp, Artificial Sequence
  Description of Artificial Sequence: Synthetic polynucleotide
tggggcggggggctgagactcctatgtgctccggattggtcaggcacggccttcggccccgcctcctgccaccgcagattggccgctagccctccccgagcgccctgcctccgagggccggcgcaccataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatctctctctggtgagtccccaggacgcccctggccctaatttcctccagctgcgcacctccggccctcactgcacgcgccagccttctttgtgcggtcgggtaaacagagggcggagtccccttggcctcgcctcccgctaaccattgttgcctccatctcttcccgtagggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctgga

SEQ ID NO: 148 - DNA, 1806 bp, Artificial Sequence
  Description of Artificial Sequence: Synthetic polynucleotide
ctttgcatagtttatcctattagtaatctattctgtctttggaatatgttttgtgatgatgaaataaatactataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagtttccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcat

SEQ ID NO: 149 - DNA, 1806 bp, Artificial Sequence
  Description of Artificial Sequence: Synthetic polynucleotide
gctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacattccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattatacaatgttattattaactatagtcactatgctgtccagtagagcttcagatcttgttcatcttgtgttcctccctccccaccctcagtccctggaa

SEQ ID NO: 150 - DNA, 1806 bp, Artificial Sequence
  Description of Artificial Sequence: Synthetic polynucleotide
ataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattat

SEQ ID NO: 151 - DNA, 1806 bp, Artificial Sequence
  Description of Artificial Sequence: Synthetic polynucleotide
tagtgacggtatcaagagcagcatcccaggttgactttctttggggcaggaccttgcttgtgtcttaacccttggttcctacccaagtttgtctctctagtcctcaactctgaaagccacttgatatcttacacaattccttttttgcctgagaaaataaaagtcagttttgatcatttacaaccaaaaatcctaactaacacagacctgtttttgaaatcaggtagattggaagtcttggtttacttcttataagcccgtccgctgtctgtcttgtaacatcccaggagcagacttaacaaggccttcctggagccttgctctttctgtctgcttccctcatctgctctctctcctctctcttcacagggtccacttcctaacacatgctgccatttctggcttatggtttggcagcagaagaccaaagcagttgtcatgctgaaccgctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatattgtggagaaagaatcggtgagtaatatttaatatttacaacttagtatactgtatgtgatcattagcatataaagattttcattttggggccaatattcattccttagttttggcctttaattgctaaaggctagcggtcaaagtgtttctgtccggaaaaactcatgtatccttttcctttcttaagtatttttataacaattgcagacctttcatctccaagatagaaatacaatggaataaatatggactagcagtgacatatagatctttggaatccctaggaatccttattgacctattgtcaataagtcctcttccagctttaagatcttgtactgttctacttcagatttcttactttattctacatttcataattgctggtttttaatgatgatgaaaatttcctaatccacttctaattagatgtggcaatgacatgcc

SEQ ID NO: 152 - DNA, 1806 bp, Artificial Sequence
  Description of Artificial Sequence: Synthetic polynucleotide
cagaatttgaatatgatgtggctgaccatagatacctccattgcattaattctgcttcataaagtgtttgatgcttgcttgtaggtgttgaatagagcctaattagcagtaagtaaacagatctagagcacagactttggcatctgaaggaccttggttcaatgctgggactgccacttactagctatgggatctttggtggatttttaacctttgaaagcctttcatccctcacagatataatggggaagaaaatcgtttccattagtattgtgaggattaaatgattaattgatgtaaacaatgtgctttccatagtacttggcatatcataagtgcttcatgttattttacgctggctgggaagataagttttgctgtggagaatttaagagggatattaaaatatatttttgttattttaaggaaattcgaaatgagtcccatgactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattatcctcatagagtggccaagtttccagaaaacagaaatcgaaacagatacagagatgtaagcccatgtaagtacttgtgggtttgtgtgcatgtgtattttttggtttgttttaggaggcaggatgtagtgaaaaggagggcttggggtcagtgttgataaatacagtaatttttttcctatttacgtaagacacgttctttaagaatttaaaggtgtagaatagtggaaggaaaaataattacccataattatttcatccttcaaacataggcaccattattttggtgtatttcccacaacctgtttttcttatgcacagttttcctttctttaaaataattgtaattatagatgtctatataatatccatatgtatttccttttcatatcattccatcccctttgtaagttttgcttaaaatagttattggtgtagtttggtttttt

SEQ ID NO: 153 - DNA, 1806 bp, Artificial Sequence
  Description of Artificial Sequence: Synthetic polynucleotide
accagttatcgttttgtaggtagaccaatcaattcttaggtaccaagaatctgaatgatccttttacttttaggaaggtaagtactttattcatttaactatgtttactcctggtcgatttttcaagtcacaatggctaatgtgctacaaacagaagtgcttcctttccagcactatagtaataaacaagattgcattttatactccttacaaaaaaagtagagaatagtttaggatttgtctcaactctattatgatgctaattcatttttcttatttcttctgtctttttataaatacctagaatattaatatgaagataaaaacagtaattttgaaatgacagttgtggtttatcattctctattttcagatgatcacagtcgtgttaaactgcaaaatgctgagaatgattatattaatgccagtttagttgacatagaagaggcatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcaaaggagttacatcttaacacaggcaagtaatacgataccacgcaaatgtctgaaaatgatgtgtttgtgcttgttctgctttaaatcataggtaaaagtatatcttgacttcttttggaaatgaaatggtatttcagtttttttctgacgatgtaatgaattatggacattataaggttttgaagctttgagtatttaagataaaaggcaagttatttttgatattacacgttctgtgaaggaaaattcttaggaaatggcttaggccagttctttggcagattgtgttccttacattatatctgacacagagtgctgcttatgcttcttagtgtcttcttttctcttcccataccctgtggcaaaaccagaggccctggacagctcttctgtagctccccctgcctcgcatatatcttcagagagtacaccaagccctggatggtgt

SEQ ID NO: 154 - DNA, 1806 bp, Artificial Sequence
  Description of Artificial Sequence: Synthetic polynucleotide
cctgctcaagggccgaggtgtccacggtagcttcctggctcggcccagtcgcaagaaccagggtgacttctcgctctccgtcaggtaggtgggccccccgcaaccccgggcattttggccactctcttgtgccatccaggccctgaaccactcattcctggttccccgtggcagtgctgactccccgtctgttcccttgcccccaacccccacactccccatccctgtctgtgcccacccatgcccatgtgtgcccccacccaggacctcagccgatccctgccctcctgcctctactcctgcaccgactggcctcaccgcctggtgccctgcagggtgggggatcaggtgacccatattcggatccagaactcaggggatttctatgacctgtatggaggggagaagtttgcgactctgacagagctggtggagtactacactcagcagtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagggtgtcctgcaggaccgcgacggcaccatcatccacctcaagtacccgctgaactgctccgatcccactagtgagaggtgagggctccgcacccccgccattcccaagcagggatgagccggctcccaccctgaacagccagggaggcagggagactggcagccggcgctgcctaccctccatcccctcccctccctgcaccagctggggctctcaatgtccctcctccctgctgtcctgggacctggtgtctcagagcctaacctaccaccctttccacctaaccccgaggaagccacagaaagctgcctcgccctactccgggagccctggccgctgcaacccaggtcccactggagacagggaggccactgctggtggccagcatgtcgtgcaggccagctctgttgttagaaagctcttcttcctctggaatcgagcctgcct

SEQ ID NO: 155 - DNA, 1806 bp, Artificial Sequence
  Description of Artificial Sequence: Synthetic polynucleotide
ctgggttcgaagcccggttagaactctggaggctaggatggcttgaacctgggaggtcgaggctgcagagagctgtaaccgcgccactgcactccagcctgggcaacagagctctggaagcttgccctagagtcagtcaagggccctaggccagtgagtaacagctcagcgtcagtttcctcatctataaaatgggggtaatatcatacctagctctcagcatgtttgtgagagacctaaatgaggtggtggatttggaagcatgtagcgcagtgcctggcacacagtaggtgcttgatttccggcccctctctgtgaatgtctctgctcagcgccttcccctgtggcctgggtcttaccttccctgacgctgccttctctaggtggtaccatggccacatgtctggcgggcaggcagagacgctgctgcaggccaagggcgagccctggtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacgtttcttgtgcgtgagagcctcagccagcctggagacttcgtgctttctgtgctcagtgaccagcccaaggctggcccaggctccccgctcagggtcacccacatcaaggtcatgtgcgaggtaaggcagccaggcggcgggggagcctctgctgaggctcctgtctgtgaccacagtgtgggtggcagggagggtctgcctgggcttgaattcaaggctggggacccagggagggagactcaagtcctgtgaatggcctaatttggctccccccagggtggacgctacacagtgggtggtttggagaccttcgacagcctcacggacctggtggagcatttcaagaagacggggattgaggaggcctcaggcgcctttgtctacctgcggcaggtcaggggtgggcccagctgcctccccacttcccctgagctgtcccccagatgt

SEQ ID NO: 156 - DNA, 1806 bp, Artificial Sequence
  Description of Artificial Sequence: Synthetic polynucleotide
tgtcacatatgtgcaatgccatgctcctgagcctttgattgcagacgtgtgggaagtgggccccgtccccacccccagtgccaccctgctctgcttctcttcccttgctgtgctctaaaacgagaagtacaagtgagttcccccaaggggtcggccgcgcctcttcctgtccccgccctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtaagggcctgccacccacggtagacaggaggcaagggtgcctggtgcccacgggacccctcctcactgccctgcctgggccgcccaggtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattggtttcaccgagacctcagtgggctggatgcagagaccctgctcaagggccgaggtgtccacggtagcttcctggctcggcccagtcgcaagaaccagggtgacttctcgctctccgtcaggtaggtgggccccccgcaaccccgggcattttggccactctcttgtgccatccaggccctgaaccactcattcctggttccccgtggcagtgctgactccccgtctgttcccttgcccccaacccccacactccccatccctgtctgtgcccacccatgcccatgtgtgcccccacccaggacctcagccgatccctgccctcctgcctctactcctgcaccgactggcctcaccgcctggtgccctgcagggtgggggatcaggtgacccatattcggatccagaactcaggggatttctatgacctgtatggaggggagaagtttg

SEQ ID NO: 157 - DNA, 1806 bp, Artificial Sequence
  Description of Artificial Sequence: Synthetic polynucleotide
tctttagctaatgttctgtagcttgttttagatctgtgtctacatattatatgtatctctgtatgcatcaatatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcagttctactctccttggaaggtgtcttaaatgggagtcttcccatttctttgtttcactctaga

SEQ ID NO: 158 - DNA, 1806 bp, Artificial Sequence
  Description of Artificial Sequence: Synthetic polynucleotide
agggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttccccctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgca

SEQ ID NO: 159 - DNA, 1806 bp, Artificial Sequence
  Description of Artificial Sequence: Synthetic polynucleotide
cctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaata

SEQ ID NO: 160 - DNA, 1806 bp, Artificial Sequence
  Description of Artificial Sequence: Synthetic polynucleotide
aaggaaaaaggcactgagtgctggggggtgctggggtgggctgcagtgatagacatcagggtagaggttaaggtcaggttcagcctcactggggtgaagtttgagcacggtgagcaggccatgcagcccgggggaggggaggatgggaggaggtggagctttccgggcagagggaacagccagtgcgaaggccccaggcaggtggcttaatgcagctgttgggggaggtgagtggtagggaggaggctggagggatgggggctgatctcacagggccagagcctggttgaccaaataaggccttggccttttctgcttggctgtcccaagaggatcccaaagagaaaaaaacgaaagtggtcttggtcacccagcctgccccacaccaggccccaccccaggtgctgagccctctgagcccctgcctgtctcccacaggctctgccctgctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacg

SEQ ID NO: 161 - DNA, 1806 bp, Artificial Sequence
  Description of Artificial Sequence: Synthetic polynucleotide
aaggtcaggttcagcctcactggggtgaagtttgagcacggtgagcaggccatgcagcccgggggaggggaggatgggaggaggtggagctttccgggcagagggaacagccagtgcgaaggccccaggcaggtggcttaatgcagctgttgggggaggtgagtggtagggaggaggctggagggatgggggctgatctcacagggccagagcctggttgaccaaataaggccttggccttttctgcttggctgtcccaagaggatcccaaagagaaaaaaacgaaagtggtcttggtcacccagcctgccccacaccaggccccaccccaggtgctgagccctctgagcccctgcctgtctcccacaggctctgccctgcaccttagggctcgggatgctgctggccctgccaggggccttgggctcgggtggcagcgcggaggacagctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagt

SEQ ID NO: 162 - DNA, 1806 bp, Artificial Sequence
  Description of Artificial Sequence: Synthetic polynucleotide
cagtgcgaaggccccaggcaggtggcttaatgcagctgttgggggaggtgagtggtagggaggaggctggagggatgggggctgatctcacagggccagagcctggttgaccaaataaggccttggccttttctgcttggctgtcccaagaggatcccaaagagaaaaaaacgaaagtggtcttggtcacccagcctgccccacaccaggccccaccccaggtgctgagccctctgagcccctgcctgtctcccacaggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccc

SEQ ID NO: 163 - DNA, 1806 bp, Artificial Sequence
  Description of Artificial Sequence: Synthetic polynucleotide
atagagtagggcgggggatgccatggagaggctccatgggggagggccggggaagcgccgctccaggaggcacgtggtccggcgcggaaggggcccatgaggcgtggaggccgccgaggtcggggtaccgagggacgcagggaggccagcgcttcctcccgggcattcgagcggggcctcgtccttcgggagaacacattctccggagccctcttcgaacgtttattagtcggttcagggcaacttgaaggccaaatgtttggcccacaggccaataaatagtacgagagccaatcggcttaagggtttattccaggtgaggcgagtgtcttagaagatgggaaacacgtagatggcgtgtttttacggaagaactaaaatatttaatttttaggcaagtgtcgtggacttcgtactgctaggaagctccgtagtcaccgacgagaccagtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataagtggcatgataaacagtataagaaagctcatttgggcacagccctaaaggccaacccttttggaggtgcttctcatgcaaaaggaatcgtgctggaaaaagtgtaagtccattgctcccgtcaagttttagtttattataggaattcgagacatgaacttacgaattcttgttttgaaagtaattgcaggtttttgtgtagtagtattcatttgggcattgtggggtaaaattgcaaagcgtttgttctatttaaaagttggtaaaattagtttttgggaattaggtagttaaggttttaatttaacgttggcctggaaggaattggagaagatactagcaatgatgaagtaaaggacacaaacacctttactgtgggagttgttataagtaaatggcacgtgtcagctattgaactttatcgacttgataaaactaaggtgaagaga

SEQ ID NO: 164 - DNA, 1806 bp, Artificial Sequence
  Description of Artificial Sequence: Synthetic polynucleotide
caagcgggacttggggtcttggggacgggcgggcggatgcgaatagagtagggcgggggatgccatggagaggctccatgggggagggccggggaagcgccgctccaggaggcacgtggtccggcgcggaaggggcccatgaggcgtggaggccgccgaggtcggggtaccgagggacgcagggaggccagcgcttcctcccgggcattcgagcggggcctcgtccttcgggagaacacattctccggagccctcttcgaacgtttattagtcggttcagggcaacttgaaggccaaatgtttggcccacaggccaataaatagtacgagagccaatcggcttaagggtttattccaggtgaggcgagtgtcttagaagatgggaaacacgtagatggcgtgtttttacggaagaactaaaatatttaatttttaggcaagtgccgcggatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtgtaagtccattgctcccgtcaagttttagtttattataggaattcgagacatgaacttacgaattcttgttttgaaagtaattgcaggtttttgtgtagtagtattcatttgggcattgtggggtaaaattgcaaagcgtttgttctatttaaaagttggtaaaattagtttttgggaattaggtagttaaggttttaatttaacgttggcctggaaggaattggagaagatactagcaatgatgaagtaaaggacacaaacacctttactgtgggagttgttataagtaaatggcacgtgtca

SEQ ID NO: 165 - DNA, 1806 bp, Artificial Sequence
  Description of Artificial Sequence: Synthetic polynucleotide
ttgtatatcctttttaaagttattctttttagttaattgctctatgtgtattgagactaggaatcagaaagcttagattctagtcccaggtgtaagttgtgtaacccttggcaagtgtcaatctctaggcctcagctttctcatctataaaatgaggaagttgtcgtattctattttttttcttaagatgatacacttaaatgttcccttctgttgggttatataattgcatcaaaagtgtagtaatgttattaaaaaattgttagagatccaaactaaggtctctttcaactctcccattcttttttctgtgactttatggtaataatgaaactggtggttttcttttcttccccctcacagtatctcagagatgttaactgtcctttcaagattcaagatcgacaagaagctattgactggcttcttggtttagctgttagacttgaatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattatggagataatggtacgttttgtggggaatgtgtattttaaagagagaggaaagatgggaaagggagtgtgaaaatgtagggaactttgcagtttgttttgtctagtactattttacctttggtttattcttatcacaagttaaaagcacttttattgtctttcattggtgtttatatatttctgttagaatttggaaatggtgccctctggagaaggctaattgactgtcttctcacagagtaacactactttgataatatggtctgcaccttagcctttcaaattaaattgtttttagtgtcccagaattgatgggactttgaagtgttgttgcagtaggtaatttctcaaaagactgaaacatgtctaatgccaatatacattaatactctataggccagaatatattacttatgtttactgtcttagcacagatacttctatggt

SEQ ID NO: 166 - DNA, 1806 bp, Artificial Sequence
  Description of Artificial Sequence: Synthetic polynucleotide
gcacctgttatgtaggaggagtaataaaatgaatgaatgcactcaaaacactaaacagtaattctgtaatccaacgggaggtacagcgaataccaaaagcctacatatactattctctgcatgctatagcaagaaagaaaggaaagtggcttcccggtggttttctgcctattgtacaaccaggaagctgacaataaagtttatttgagcgtcgacgtgcgccgacgtggccccgcctccccagccggagccgcgattggtgggcatttgccggcggccaccgcttttaagccacgattggcgaaggccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataagttgacggctctcgactaccacaaccccgccggcttcaactgcaaaggtgaggcggcggcctcagcccggccgcgtgtccctgacctgggcggaggtcccagcctcagtgcccgcaccccacctccccgtcgggaccctcggcggcctggtttccgccggcagcctccgggcccctctcctctgggtcgccacgtacctcggctcttcgccgccccttcccgcctttaaagccctctcacctactcctgtctcggcatgttactttctgcacttgcttaactccaagcatcacgtaactaccttctctgtacataaaagggagagcattcgtctttctcactcactattcaactccatggttccctgggtaattaggcgataccttgagcacctgctaattatgggccagcgcggtgctggattctgaggaaggtgctgagtaacttg

SEQ ID NO: 167 - DNA, 1806 bp, Artificial Sequence
  Description of Artificial Sequence: Synthetic polynucleotide
cactaaacagtaattctgtaatccaacgggaggtacagcgaataccaaaagcctacatatactattctctgcatgctatagcaagaaagaaaggaaagtggcttcccggtggttttctgcctattgtacaaccaggaagctgacaataaagtttatttgagcgtcgacgtgcgccgacgtggccccgcctccccagccggagccgcgattggtgggcatttgccggcggccaccgcttttaagccacgattggcgaaggccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggtgaggcggcggcctcagcccggccgcgtgtccctgacctgggcggaggtcccagcctcagtgcccgcaccccacctccccgtcgggaccctcggcggcctggtttccgccggcagcctccgggcccctctcctctgggtcgccacgtacctcggctcttcgccgccccttcccgcctttaaagccctctcacctactcctgtctcggcatgttactttctgcacttgcttaactccaagcatcacgtaactaccttctctgtacataaaagggagagcattcgtctttctcactcactattcaactccatggttccctgggtaattaggcgataccttgagcacctgctaattatgggccagcgcggtgctggattctgaggaaggtgctgagtaacttgaagactagttcactgcctgccaggagctaaagggacgaggggtggaag

SEQ ID NO: 168 - DNA, 1806 bp, Artificial Sequence
  Description of Artificial Sequence: Synthetic polynucleotide
ccgggttaggcataggccctcccggatcttccgcggtgtaaggagaaggccagcgcccctgtgataggcccagagcccccactccacaagccagcccatcccccacggagacccaaaccgtccacacacaccttgccagctgtttgggccccacgccgccccaaaacacgcctccagctggccccttgggacctcccttctctagtccgtattttgacctggcccgtggcagattcgccactcccccctaccccaagcagcctgggcctcgatgggccgttgtcggggcccggagattgaagtggtgttggatcctgctgctggccgcgctggggtagaagggtcgccggtgtgtgggcagagcggcccccgcgtctcacctttaattttctttccttaggcggtaaccagcgtgagctcgcccgccagaagaatatgaaaaagcagagctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctcctcactggtgttgctgggtgtggtcctcaatacagaatagag

SEQ ID NO: 169 - DNA, 1806 bp, Artificial Sequence
  Description of Artificial Sequence: Synthetic polynucleotide
aatcgagccctttgcccacggctacttcacgggaccaccctcccgggttaggcataggccctcccggatcttccgcggtgtaaggagaaggccagcgcccctgtgataggcccagagcccccactccacaagccagcccatcccccacggagacccaaaccgtccacacacaccttgccagctgtttgggccccacgccgccccaaaacacgcctccagctggccccttgggacctcccttctctagtccgtattttgacctggcccgtggcagattcgccactcccccctaccccaagcagcctgggcctcgatgggccgttgtcggggcccggagattgaagtggtgttggatcctgctgctggccgcgctggggtagaagggtcgccggtgtgtgggcagagcggcccccgcgtctcacctttaattttctttccttaggcggtaactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagcgcgagcttgcccgccagaagaatatgaaaaagcagagcgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctc

SEQ ID NO: 170 - DNA, 1806 bp, Artificial Sequence
  Description of Artificial Sequence: Synthetic polynucleotide
ttcaaaaggaatctttttgtttcaactattaggatctttttaaatcaaatatgtattttaatggtgtacaccagacctgaagaaaaagatcacagaaggaatttcccctttgtaagatagaggtagttaaaaataagccttatgacctaataggttaattgtaatgctctggtagccaacttgaaaaaggagaaatgatggttgcatctcacattttaaaatgttaagaatttgttttgtaatgaggataccttaacccctgaaggccaaaatgactatttgtgtgagtttgagaaaggcacatagtaacttggggaacagtcaatagaatgacaaaatcttgactattttaactttctgaaccctgtcatttcttgtgttctcaaatttgatttttaaataggctgcatggtgtatgaaaagctgggggaacaagtctttggcaccacatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgggaagttcgtaatctttggagccacctctctacagaacactggaggtaaaaagaacatgcttttctttacataacttgaaactaattctggtggatgagcggccacatgaattttaacataattcaagcagttatcatcctcattgctaaaatggcacagggaaagtaaagcagagacagcagtcacttatttaaagccacaaatcctgctagagtagctgaagttgcctttgtgtcttactgacagttggtctaagaacgggctgataactttttatgtagcttgcaacataagccttcgtatcttctttctaaaaatgttctcattttccttcagcaatgctgagctacctcttcatcgtaaaaaatgaactaccctctgccataaagtttctaatgggaaaggaagagacattttcgtaagttatagaccatttttttatgatata

SEQ ID NO: 171 - DNA, 1806 bp, Artificial Sequence
  Description of Artificial Sequence: Synthetic polynucleotide
taaagatgtcaagcttcaaatcattatcataaggttaaatatattacgcatgtctttacagcaagtttatttctgatcgtgaaagtagaagaagtctcacaaacagccatttggaaaaaaagaagtgtgatgagtatgtaagtatcattataatgaagtatgcttatttttttaatcatataaattgggacaaatctttttaattcaagtagcatagtaccaaaagcataactacctgtattcaccaggatattcctcataccttatgtattttctcttgaaatccattcaaggaaataactagataactaagaatggattttcttgaattttacttccatattggttcctgagagtgcattaaaggctttggcttgatgaactttcttggggattattttgcttagtgtcaatgtttgtttctttgttcagattccaggtacaacctcctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttaggcatgtcagtttttaacctaagcaacgccattatgggcagtgggattttgggactcgcctttgccctggcaaacactggaatcctactttttctgtgagtattgacgtgccggtactttccattttaaaactgaactttttgtatgtttctgttattacatagaagaaatgtgaaatatttataaatagtttttttattaacttggctaagttacaagtacatactttgatatttattgcttgagtgattttccaaactgtacctaatgcttacaacaaagaggaaggagaaaatctttttattaatcaaaaatactgaaataagcatttgtgaaaaggattaaaacatttgaaaataactttttttggtatttttggagtctacctgtgactttaaatctcagttaaaatattaagaggtgtttaaccccagccagtcaccactt

SEQ ID NO: 172 - DNA, 1806 bp, Artificial Sequence
  Description of Artificial Sequence: Synthetic polynucleotide
atcattcttcacactagttccttttctgactcttcagtcacctccagaattaatatccttagaagcatctctaaaatgagtttgatttactaaacatagaagttgacaaagtttttcaagtataactgcataaactctcttttttaaaaaatcagtttttcccaagttgttagcctttcattggcatttgagtcatttatgtgacatatttataagaaacatctgctagtgctgctgcatacttttatcagatccattaaatagtacatttttgttcttgattctcactaaaactaactaaatggctgtcattcttttctttatgcttttattgtactaatttagcccatttgactgcacttttttttttttttttttaaagttccctcctttcttttccccttgcttcccaacaggtctcttgatggtcgtctccaggtatcccatcgatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccaggtaggaatattgcaagtttttttcttggttttgaattaaatgcctgaacttcagtatatttaagtactcttgtgacccaggaaaattttagtgtaaattctaataaattaccttaaattgtgcatattatttggtggtaattaaaatttttttatttttaaaaatttttaatgagaaaacatatctgtttcttggaatagcatatgatttggcatgaaagtgcatatccaggaaatcctgtagattggcagtctgctcagcgctatgctgatgtgcttctacatgtccct

SEQ ID NO: 173 - DNA, 1806 bp, Artificial Sequence
  Description of Artificial Sequence: Synthetic polynucleotide
ttctatattaaaaatcagttgacatctgtttttagataattttttaaaaaactggattataaaatgaagcacttagtaaagctgatggcagaggttttagatcttttgaatacaggaaagtggtaagggcattataggtatgattcattgagctagagggcgttggtgttcacattttaaaaacataatcatgacttatctggagtcacatgttccattttattggcttccttcatatagaaaatatagtaaccagcactacatgcctgtgaaaaagtgaagcaattgtatattttctgggtgaaggaagtattctgtacattctccatgttttacatcatggtattttgaataaccatgcttccatgttcacatcaattttttgtttttcaatttatgcacagcacttgctctgaaatttggggactgagtacaccaaatacgatagattccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagtgggatacaacaggcctttacagcttctctgaacaaaccaggtgaatattctgccctctgtcgaatcttagagatcttgtgggaggggggtatattttgaaagacctatatggggttgcttagtataattttgcctaggatgtttccttaatgtaaaataaggcatagcatttaaaatatctgcttgccagtataaaaaatatattaaatgtttcagctgatgttttaatcaatgcaattctagtttgaatcttctttaaattactgtatcccctaaagaataataattttgataactatatatttattttagcttgagatcagattataatctgttgttggcctaatttttaagtagatacatgatgagttttgctaaatttcttgttatcagaatctcatctttatactaataaatacatacttaatgaaccccttatatcacaa

SEQ ID NO: 174 - DNA, 1806 bp, Artificial Sequence
  Description of Artificial Sequence: Synthetic polynucleotide
tcaatgtatttttgtatagtcttttgagattagagtgaagttctaaaaagtaagagaaccttttgtgaaaatattttaattgacactactaagagtttaaaatagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttca

SEQ ID NO: 175 - DNA, 1806 bp, Artificial Sequence
  Description of Artificial Sequence: Synthetic polynucleotide
gggctcccgcagcacagcctttctccggccctagcccaaatcgcccagaccaggcgcggatcccagcctggccagcaggcggcgggcgcggggcggcgagccggggccggacggctggagccagaaccggctgctctccacgcccccctctcggtgctgcccggaggccggactccgcctccaccgagcccccacccgccgggaagagctccgcggagtacagagcccattttctagctgtgtccactgaggctgaacggatccgcgcggacttggtgctccgtgctcgccccctagggccgggtccgccgggagcgccgccctccggagttgtccggccggcgcacacctgcccggccccgcagcgccccagctcacctctttgtctctcccgcagcgcacccccggacgctatggcccacccctccggctggccccttctgtaggatgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctg

SEQ ID NO: 176 - DNA, 1806 bp, Artificial Sequence
  Description of Artificial Sequence: Synthetic polynucleotide
ggatcccagcctggccagcaggcggcgggcgcggggcggcgagccggggccggacggctggagccagaaccggctgctctccacgcccccctctcggtgctgcccggaggccggactccgcctccaccgagcccccacccgccgggaagagctccgcggagtacagagcccattttctagctgtgtccactgaggctgaacggatccgcgcggacttggtgctccgtgctcgccccctagggccgggtccgccgggagcgccgccctccggagttgtccggccggcgcacacctgcccggccccgcagcgccccagctcacctctttgtctctcccgcagcgcacccccggacgctatggcccacccctccggctggccccttctgtaggatggtagcacacaaccaggtggcagccgacaatgcagtctccacagcagcagagccccgatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgc

SEQ ID NO: 177 - DNA, 1806 bp, Artificial Sequence
  Description of Artificial Sequence: Synthetic polynucleotide
cggactccgcctccaccgagcccccacccgccgggaagagctccgcggagtacagagcccattttctagctgtgtccactgaggctgaacggatccgcgcggacttggtgctccgtgctcgccccctagggccgggtccgccgggagcgccgccctccggagttgtccggccggcgcacacctgcccggccccgcagcgccccagctcacctctttgtctctcccgcagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttc

SEQ ID NO: 178 - DNA, 1806 bp, Artificial Sequence
  Description of Artificial Sequence: Synthetic polynucleotide
ggcagacaaacagttaaaacagaggagtggggtaagtgatgacctaacccagccccgctgctctagttttgttaaacacctcatctgctatcacggtctggcgaaaccctggagaaactattatttccacgacggaaacatgtaatatcgaagcacgttaaattccactcaaagtggcggcgtctgggatccctgacaaagagccctgggctgcttggggcccattgttaccagaagcaacctaggcggctcagtgctggggactgagccagctacaatccctactattttccgggcccgaagccccgaatgtgctcagtacagggtggggaaaggtagaggaaggcggcggtccgcggcagacagactccggtggctcccagacaccgggaacccagggagcatcgcccggctcccctcccgctgcttacacttcttcaaggtgatatatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgacgctgcccgacgtccggcacttctggaaaagtctggtcagctccgtcaggaactggaaaacaacaggcccagccccgttagccagccccaaatcctcgtcctgccgcgtcaaggccctggtcctcctgcaggaggcacaggtctcgagtaacgcctgagccgcccccttccctcggccggccaggcctagccatacctgctcgctctccaacaacaccatcgcggcgacgctggctcgactccctccgcttaagcccctagcagtgagagccggaagttcggcctaggctgggcgggacttccgctactagacttccattgtcttccaccaatctcttctcttccaccaatcccggcctgcgccctcccccctccccgcccgcctagcgcccgcgccctgggacgtccgggggcctgtgacccggaggcgctggggctgtcctgggtc

SEQ ID NO: 179 - DNA, 1806 bp, Artificial Sequence
  Description of Artificial Sequence: Synthetic polynucleotide
gtctgtctgccgcggaccgccgccttcctctacctttccccaccctgtactgagcacattcggggcttcgggcccggaaaatagtagggattgtagctggctcagtccccagcactgagccgcctaggttgcttctggtaacaatgggccccaagcagcccagggctctttgtcagggatcccagacgccgccactttgagtggaatttaacgtgcttcgatattacatgtttccgtcgtggaaataatagtttctccagggtttcgccagaccgtgatagcagatgaggtgtttaacaaaactagagcagcggggctgggttaggtcatcacttaccccactcctctgttttaactgtttgtctgccgctcagccacgtacgcggccgtgttcaccaggatgcattttttccttcagatgacggtcgaaccaaacccattccaaagaagtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggtactgtggagggctttgagcccgcagacaacaagtgtctgttaagagctaccgatgggaagaagaagatcagcactgtggtgagcttaatttctaaggctgtcttttgaaatgtaaagacttgaacttaacagaggatggggcgtttctgaaccaggcttttatttgtttttcccttttgccctgtgtggctatttttgagaccaggaccttcctatactttagtagtggaaacctcaagaataaaataagaaggtagaggtcagacagtcgttagttctgctaaagctcttgtggaaatgaaagtagcatattggtccttattcgtagtactgtaaggagcagctggcataaatatttgattccttagccccttactgtgctgggccttcaataagcagtttcttggtaccaggtgatgctattatttccttatctttgtggttcac

SEQ ID NO: 180 - DNA, 1806 bp, Artificial Sequence
  Description of Artificial Sequence: Synthetic polynucleotide
cccacgtcagtgagtgctcacaagtctgtgaggtaggcggcgccacagagagaaactgaggcgcgggagcccaagccacttgtccagcgcctcagccgagcgcgaaccgcgctcggggatggcatccacacggcccggccccaggctctccctgtcagcgcccgaaggcccttcgcacctccagggggcgccggcctgcgcgcacgcgcaatggtcgcagccgcgttctctttaagaggactccttttgcctccgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccggtgaggcccccgcgcccctgccctctcctcctcggtgcctgaggcccccgccttccctgctgtcccctcccccagggctcccctccccccggcctcccctccccccgcctccgcgcagacccctcacggcgccccctcacgggtggaggatgaggcagcctctcctcgcaggcccgggccgtccttcgcgccgtcgtcacttcctttatttttattattccaatattttacttagaaacccaaaagctgagcctttggagggcccaagcccgcctgcaccggcctcggggggtccaaatgagccttgtccgcc

SEQ ID NO: 181 - DNA, 1806 bp, Artificial Sequence
  Description of Artificial Sequence: Synthetic polynucleotide
tgtggtgtgcttttcgagaaaatgctcacgaagattagaaaaacactgatggtttattggcaaaatcaataatctgtcagcagttgattcttttttttctctgaattagccctcttatgagtaatctgtttgctcattcattataatttcatacctctaaaactgcgtgtgacagctgtaaaggttaattccagtatcatgaaacgtctccaaaccaaagcagaagtgcttcaggatcctgatttgtgtgtttttttcttcactctaggtttcccttttatgcttactactcatgcccctcacttggaaagtcacttggcctcctgaacagcactaactccaaacgttttttttgttgttgttgttttttttagagatgcagaggatgctatttatggaagaaatggttatgattatggccagtgtcggcttcgtgtggagttccccaggtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacttatggaggtcggggtgggtggccccgtggtgggaggaatgggcctcctacaagaagatctgatttccgagttcttgtttcaggtatgttcctttcaaacagaatgagatgatacatgtaaaatacttaacacagagtctgtcttccaagaaatgatagctgttattcttcagtgcatgggacacgggggctttcttttcaatagcctgtgtgaagccttgccctggattgccaatgaggaaagtatcctgcaaatgaaattgcgctgggagtgcagccttggaagaacataaccatatttcttgtaaaggagttttctagtggtgagaaggaaagatgatgggaaaacttgagctacaattctaaagatgcttcttttggaatatacttggcatcagacatggtagaaaggcattcaaggagccagatttgaacaacttacccagcc

SEQ ID NO: 182 - DNA, 1806 bp, Artificial Sequence
  Description of Artificial Sequence: Synthetic polynucleotide
gatggcatccacacggcccggccccaggctctccctgtcagcgcccgaaggcccttcgcacctccagggggcgccggcctgcgcgcacgcgcaatggtcgcagccgcgttctctttaagaggactccttttgcctccgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtgcgcttcgaggacccccggtgaggcccccgcgcccctgccctctcctcctcggtgcctgaggcccccgccttccctgctgtcccctcccccagggctcccctccccccggcctcccctccccccgcctccgcgcagacccctcacggcgccccctcacgggtggaggatgaggcagcctctcctcgcaggcccgggccgtccttcgcgccgtcgtcacttcctttatttttattattccaatattttacttagaaacccaaaagctgagcctttggagggcccaagcccgcctgcaccggcctcggggggtccaaatgagccttgtccgcctcctgcctggggcagcaccgtagggggaagcggccgcggggcagcgcgggggtcgccgttcgcccttcccgctcgcctctcccccggcccgtgctcgccgtggctggagagcaagct

SEQ ID NO: 183 - DNA, 1806 bp, Artificial Sequence
  Description of Artificial Sequence: Synthetic polynucleotide
gtaactgactagccttagtagactgtggtttccaggtttattcagaagtagcaagatccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttaaagaggaaaaagcaagttgctccagaaaaacctgtaaagaaacaaaagacaggtgagacttcgagagccctgtcatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattcttctaaacagagcagcagcagcagagatgataacatgtttcaggtaaagttggctattttttttttttttttttttgacatggagtcatgctctgtcacccaggctggagtgcagtggcgccatctcggctcactgcaacctcagcctcctgagttcaagcagttctctgcctcagcctcccgagtagctaggattacaggcatccgccaccagacctggctaatttttgtatttttagtagagatggggtttcaccatcttggccaggctggtcttgaactcctgaccttgtgatccaactgcctcagcctccaaaagtgctgggtttacaggtgtgagccaccatgccttgccaaagttggctgtttctttagattcagaggaattattatctggcttgatctgaagaatgttaaaagtactatgatctgataattgcctaatatg

SEQ ID NO: 184 - DNA, 1806 bp, Artificial Sequence
  Description of Artificial Sequence: Synthetic polynucleotide
ataaataaacatatcctggaaatggaataagttggttatattctttttaattagtatatctgcttcgtaaaataagtaactgactagccttagtagactgtggtttccaggtttattcagaagtagcaagatccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataagaggaaaaagcaagttgctccagaaaaacctgtaaagaaacaaaagacaggtgagacttcgagagccctgtcatcttctaaacagagcagcagcagcagagatgataacatgtttcaggtaaagttggctattttttttttttttttttttgacatggagtcatgctctgtcacccaggctggagtgcagtggcgccatctcggctcactgcaacctcagcctcctgagttcaagcagttctctgcctcagcctcccgagtagctaggattacaggcatccgccaccagacctggctaatttttgtatttttagtagagatggggtttcaccatcttggccaggctggtcttgaactcctgaccttgtgatccaactgcctcagcctccaaaagtgctgggtttacaggtgtgagccaccatgccttgccaaagttggctgtttcttt

SEQ ID NO: 185 - DNA, 1806 bp, Artificial Sequence
  Description of Artificial Sequence: Synthetic polynucleotide
aattagtatatctgcttcgtaaaataagtaactgactagccttagtagactgtggtttccaggtttattcagaagtagcaagatccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttaaagaggaaaaagcaagttgctccagaaaaacctgtaaagaaacaaaagtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacaggtgagacttcgagagccctgtcatcttctaaacagagcagcagcagcagagatgataacatgtttcaggtaaagttggctattttttttttttttttttttgacatggagtcatgctctgtcacccaggctggagtgcagtggcgccatctcggctcactgcaacctcagcctcctgagttcaagcagttctctgcctcagcctcccgagtagctaggattacaggcatccgccaccagacctggctaatttttgtatttttagtagagatggggtttcaccatcttggccaggctggtcttgaactcctgaccttgtgatccaactgcctcagcctccaaaagtgctgggtttacaggtgtgagccaccatgccttgccaaagttggctgtttctttagattcagaggaattattatctggcttgatctgaagaatgttaaaagt

SEQ ID NO: 186 - DNA, 1806 bp, Artificial Sequence
  Description of Artificial Sequence: Synthetic polynucleotide
cacattttaatttttgtttccatgctctttagaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatc

SEQ ID NO: 187 - DNA, 1806 bp, Artificial Sequence
  Description of Artificial Sequence: Synthetic polynucleotide
aatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagctt

SEQ ID NO: 188 - DNA, 1806 bp, Artificial Sequence
  Description of Artificial Sequence: Synthetic polynucleotide
ggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacat

SEQ ID NO: 189 - DNA, 1806 bp, Artificial Sequence
  Description of Artificial Sequence: Synthetic polynucleotide
aaagggaggttgagatgggctgaggtcttctaggaggcggggagggagtgcagccttgacaagcctccctgtgggcgaggtgtaaagaggggcagaagtcagctctggaagcatagggcagtgggtggggaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcc

SEQ ID NO: 190 - DNA, 1806 bp, Artificial Sequence
  Description of Artificial Sequence: Synthetic polynucleotide
gaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcctcacccagaccaattcaatcagaatccctaatagcagagctaaacaagggtaaggtctaaaagcatttccaggtgattctaatgggcagccaatactgagaaccactgttcttatgtaagaagcacatc

SEQ ID NO: 191 - DNA, 1806 bp, Artificial Sequence
  Description of Artificial Sequence: Synthetic polynucleotide
cctccctgtgggcgaggtgtaaagaggggcagaagtcagctctggaagcatagggcagtgggtggggaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacaacggggaacatttctgcagagaaaggtggctctatcatcttacaatgtcacctctcctccacctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcctcacccagaccaattcaatcagaatccctaatagcagagctaaacaagggtaaggtctaaaag

SEQ ID NO: 192 - DNA, 1806 bp, Artificial Sequence
  Description of Artificial Sequence: Synthetic polynucleotide
taatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagattccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccaga

SEQ ID NO: 193 - DNA, 1806 bp, Artificial Sequence
  Description of Artificial Sequence: Synthetic polynucleotide
gattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaag

SEQ ID NO: 194 - DNA, 1806 bp, Artificial Sequence
  Description of Artificial Sequence: Synthetic polynucleotide
ttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcacc

SEQ ID NO: 195 - DNA, 1806 bp, Artificial Sequence
  Description of Artificial Sequence: Synthetic polynucleotide
attattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagcccctt

SEQ ID NO: 196 - DNA, 1806 bp, Artificial Sequence
  Description of Artificial Sequence: Synthetic polynucleotide
ttcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactc

SEQ ID NO: 197 - DNA, 1806 bp, Artificial Sequence
  Description of Artificial Sequence: Synthetic polynucleotide
cagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccatccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatg

SEQ ID NO: 198 - DNA, 1806 bp, Artificial Sequence
  Description of Artificial Sequence: Synthetic polynucleotide
tgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgaccctccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgagagggagccccgcctgctgccctgtttgcactcggcctgtagtgcctgcttagggcccgcggcccccgccgccgccaacagctcgggggacggcggggcggcgggcgacggcaccggtaagtacgaagtgatcggtgccacccctccccctactctctgcctttgattccgactgggtgcagagatgaggatgccacctgggcgagaggatgggggcccggacagggcacgggaaatactttctgggtcctgcatacgaacgtgggtttgtgctggccgctgagatgggacatctgactaaagttggagaaaagaaggctcggggaggggaggggctggttcgctgcgggataatggtcgggggcccacccagcaggggaatggtgggggccataacctgggtgggaacttgtaacagtctcccacatccctgcttctcgaagtggtg

SEQ ID NO: 199 - DNA, 1806 bp, Artificial Sequence
  Description of Artificial Sequence: Synthetic polynucleotide
tcgaagtggtggactgtcccgtgtgcaagcaacagtgcttctccaaagacatcgtggagaattatttcatgcgtgatagtggcagcaaggctgccaccgacgcccaggatgcgaaccaggtgcgtcctatctcagcaaccacaaggaggtttctggggagggggcatctgcgcaggaggagcttggcaccagctccaggctgttactccactttcccaaggctctgggtgggctgcctaggttgggtcaagggaccaatcttaaatctccggttgtattttctgggatgtaaacgtggatctatcaagttgtcttgccttctctgaccctgcctttgtctggcagtgctgcactagctgtgaggataatgccccagccaccagctactgtgtggagtgctcggagcctctgtgtgagacctgtgtagaggcgcaccagcgggtgaagtactccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataccaaggaccatactgtgcgctctactggtacatgaggctgaggggggctgttggagttgttctcccatgtgtgccctcagttgcttttatgatgttggttgcatctggtggatgggtcctagagttctctagggggtgccgcccgaagggcccgagggcagaactccagaagcagaaaaactggggttgtggtgtgtagtctctagggcctaggtgggagagggtgggaaggggaaataagggagaccttaatgtgctgcagggaggtacaaagggtttgagaaggcttatcagggagttgtcagacctggtggtgaagggctcagcatatgcaaacagggaaaggcatggtgtgaagggctttctgggtttgtggttccctggcacacatctggtataagatgctgctagggaaagtagactgtgggtccatggattataagtgatga

SEQ ID NO: 200 - DNA, 1806 bp, Artificial Sequence
  Description of Artificial Sequence: Synthetic polynucleotide
ggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgcttccggatccggagagggcaggggatctctccttacttgtggcgacgtggaggagaaccccggccccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccggtaagtacgaagtgatcggtgccacccctccccctactctctgcctttgattccgactgggtgcagagatgaggatgccacctgggcgagaggatgggggcccggacagggcacgggaaatactttctgggtcctgcatacgaacgtgggtttgtgctggccgctgagatgggacatctgactaaagttgg

SEQ ID NO: 201 - DNA, 2541 bp, Artificial Sequence
  Description of Artificial Sequence: Synthetic polynucleotide
atctcggccaataaaggagaaagggcgcggcccgtacgcgcgccaggtgcgtgggcgagaccagctcacgcccctcctccagccgccaaggccccggcccacagctgcctggctgcagtcagaagcgtagcccgagacaaggaagggcgccttgactcgcacttttgtccggttcgaacgttctgctcagtggtgcgtggaatgcgagcgcgtcttaaaatcgatggcgcctaggagtccatgaaatacggtacaggcttccggcgacggatgccccgcccctcacccacgctccgccctccggggatgccccacccctcgtggcggtcccgcccgtccccgcgcaggcgcgctcgggctgccgctggctcttcgcacgcggccatggccgactccgagctgcagctggttgagcagcggatccgcagcttccccgacttccccaccccatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagccc

SEQ ID NO: 202 - DNA, 2541 bp, Artificial Sequence
  Description of Artificial Sequence: Synthetic polynucleotide
tgccccgcccctcacccacgctccgccctccggggatgccccacccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttccttctgcgagctggtattgagcgcctgccacgagccaggccttccctggtgaagatcacggaatgcccacccagggaagggaggcctggaggcctccgggagagcccaagaggtggcccagggaga

SEQ ID NO: 203 - DNA, 2541 bp, Artificial Sequence
  Description of Artificial Sequence: Synthetic polynucleotide
cgttctgctcagtggtgcgtggaatgcgagcgcgtcttaaaatcgatggcgcctaggagtccatgaaatacggtacaggcttccggcgacggatgccccgcccctcacccacgctccgccctccggggatgccccacccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccaggtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttccttctgcgagctggtattgagcgcctgccacga

SEQ ID NO: 204 - DNA, 2541 bp, Artificial Sequence
  Description of Artificial Sequence: Synthetic polynucleotide
agtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcaga

SEQ ID NO: 205 - DNA, 2541 bp, Artificial Sequence
  Description of Artificial Sequence: Synthetic polynucleotide
aagatcttaatcttctgggtttccgttttctcgaatgaaaaatgcaggtccgagcagttaactggctggggcaccattagcaagtcacttagcatctctggggccagtctgcaaagcgagggggcagccttaatgtgcctccagcctgaagtcctagaatgagcgcccggtgtcccaagctggggcgcgcaccccagatcggagggcgccgatgtacagacagcaaactcacccagtctagtgcatgccttcttaaacatcacgagactctaagaaaaggaaactgaaaacgggaaagtccctctctctaacctggcactgcgtcgctggcttggagacaggtgacggtccctgcgggccttgtcctgattggctgggcacgcgtttaatataagtggaggcgtcgcgctggcgggcattcctgaagctgacagcattcgggccgagatgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcg

SEQ ID NO: 206 - DNA, 2541 bp, Artificial Sequence
  Description of Artificial Sequence: Synthetic polynucleotide
aggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatcctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttg

SEQ ID NO: 207 - DNA, 2541 bp, Artificial Sequence
  Description of Artificial Sequence: Synthetic polynucleotide
gatctcacattctagcgcccagacatgtcgggaacgccttacgccaacttggggtccccaccaagagaacccccaccagatctgcaccctccccttcacgcgtgcacccagtccaggctccctcaagccccacgggtgccttttagacctgaggaggttgcaaacctgatcccccatacctgccccacccatccgcggacaacccgccctcgcaaactcagacccccacccggaggcttcagattcctcccaggtccagctgccggaaatgcgtgtttgaagggagggtgtgggctcaggggcgaagcacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatagcggggccgggggcggcggcggcggcggcggcggcggcggcggtggtggaggcggcggtggcggtggaacggccatgcgcatcctaggcggagtcatcagcgccatcaggtaaggcggagactatcagaggggcggggcctgggaatgggaggagcctcagtgaggcgtggtctgggaggggcgtggtctaaaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgtt

SEQ ID NO: 208 - DNA, 2541 bp, Artificial Sequence
  Description of Artificial Sequence: Synthetic polynucleotide
cgggcatttaggaagcgggccatggagtagggtcttgggcagatggcacctgaggaggataaggccttgggaagctggggcagagcctctatgaagtgagccctccaaggggcggggtcttttgattctacgtgggattttttaggtttagggtggccaagatgactgaaatctgccactgggtaggtgtgcctggcaggaggggagcctcccaggggaccggtctctgggtttcctcgagggtggggttggcctgaggaagggagaagaggggcacgaccagggcagtgtggattgggacagatgaggacaagaacaaatgaaaggcacagcaaccaagtaaggaagataacggctggggtctggagcgttggggctgatggttctgtagtgctgcccgttggaggccccgcccctggcactaacccctcccccttatctcttcgcagctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgaggcggctgcgcagtacaacccggagcccccggtaagccccctctgcaaccagacccccttctcctgccaaggcctcttcgaggtcccatccctgttcctgtagagaagccccaccttcctccccttcttgtgaaattcctctgccagttcctcccatgccgtgtctgcagcttcgccatgggtcttagccatgccccacatacgtgcaccccattcactaccacccctcattcttttcctcatcaagctgcccagcccactctgacttccccacccagggtacctgggtttggggagccgtcctggccgggttcccctccccctgctctgagctctcctccctttgcagcccccacgcacacattactccaacattgaggccaacgagagtgaggaggtccggcagttccggagactctttgcccagctggctggagatgtaagtaac

SEQ ID NO: 209 - DNA, 2541 bp, Artificial Sequence
  Description of Artificial Sequence: Synthetic polynucleotide
gctgatggttctgtagtgctgcccgttggaggccccgcccctggcactaacccctcccccttatctcttcgcagcgaggcggctgcgcagtacaacccggagcccccggtaagccccctctgcaaccagacccccttctcctgccaaggcctcttcgaggtcccatccctgttcctgtagagaagccccaccttcctccccttcttgtgaaattcctctgccagttcctcccatgccgtgtctgcagcttcgccatgggtcttagccatgccccacatacgtgcaccccattcactaccacccctcattcttttcctcatcaagctgcccagcccactctgacttccccacccagggtacctgggtttggggagccgtcctggccgggttcccctccccctgctctgagctctcctccctttgcagcccccacgcacacattactccaactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatattgaggccaacgagagtgaggaggtccggcagttccggagactctttgcccagctggctggagatgtaagtaacctggggtccctggccccgtcctaaccgttccatcccttcccttgtggctgcccttgcacacacacccttgaccatgacaatcccagtgttcccattctccatgacattctcagacccctttcagtcacccctgacctgcccctaacttccgcccgcaggacatggaggtcagcgccacagaactcatgaacattctcaataaggttgtgacacgacgtaagtgaccggggttaaggaatagggtagattcagaggcagaggggtcagagaggatttgacctctggcctctgactttcaacctgttacccacagaccctgatctgaagactgatggttttggcattgacacatgtcgcagcatggtggccgtgatg

SEQ ID NO: 210 - DNA, 2541 bp, Artificial Sequence
  Description of Artificial Sequence: Synthetic polynucleotide
ggagagttatagcagatggagacaaaaaagggaactgctggggatcaaaccttgtaaagtccttctaagtgatatatgaggactttgacttttattcaaagttagaaggctttgaacaaaagaattatttcatttgtgttttacaatggtcacaagtgccgtagcgagaataggctgtgtagagaagagattttgtggttttcttttttgttctctgtattctcttcctgaaaaatctgttttctgcctaatcatatttctgtaaagaacaatagacttgaacgtctgctgttaagtaacaaaggttgacctaaaccacataaggtcagattaacttttaaaatatccaagataatgttaagtgtattaaatatggttcagtatgtaatcaaaatatttgatattctctagatactaatctcttttaatttttttattttttagccttggtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggctctattttgcggaattggaatttcttagctgtgacacatccaggttacatggcatttctcacatatgatgaagttaaagcacgactacagaaatatagcaccaaacccggaaggtaagactttttagcagtaatattatgtgatatatccaaagatgaaaaattctccatggtttgttcctaagtaagtcagcaatacccgctgatggcatgcttgggagggggctagaaaaggtaaaagaccaaaatggtgcttcttaacataatgttttaaattgatacattgtgcttactctgaaacttggtattcataaagtgaaaggggatatggtctcctttctgttttcatgatatccgtgtttatgtgcaaaattgaatgtatatatttgaatacttgaatactgtgctaaagaacaaataaatagaacagtcttatgttcattacttt

SEQ ID NO: 211 - DNA, 2541 bp, Artificial Sequence
  Description of Artificial Sequence: Synthetic polynucleotide
catattactcatttgtgcaatgaataaaggatttctattattatatggacccatcatcttatgactgtttttagaaaatgagaattaaatcttgattcattattaaataaccttgtatacacacatgaagaggtcatgacacataagactttgacctaataccttttttcagatatgtttctatagctatcttgatagcctaggactgtttgagagaaaattaatttaaatttttgtcatattcttagcaaatgcaaaataattgagttaaacagaacccactacatttgttctgaaatatgaacaatattctcaaatatttgtctggtagtacaaatacaattatattaattttattattgaattttgctgcttcaaagggaggtatttcttaaatgatacttgattcaattatttccctttttttccaccttgcacagaactatcgtatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatccatggaaagtattcagacagtgccttcatgaggtccaccagattagctctggcctggaagcaatggctctaaaatcaacaattgatttaacttgcaatgattacatttcagtttttgaatttgatatttttaccaggctgtttcaggtaagtttatacttgcttagtctatccattcccttcttctctctccctgtcttttctctctgtttctctctctctctgtctctctctcacacacacacacataaacaaacatatggaaaatagtgtcattcctattagtctgtaattttattggtatgtttggtcattgttaaaagtttagagtgagccatttggcttaagtttggagttatcagatgctgtgagcctggtggctgcttgttagctttgagaggatccatccaaaagagctttgttttaaactctctacttagtttcttactt

SEQ ID NO: 212 - DNA, 2541 bp, Artificial Sequence
  Description of Artificial Sequence: Synthetic polynucleotide
ttaaactttagaggttcaaaataaggatatgatatagaaaagattgaatggtaggagaacagaataggatttatttatattatgacaaacgtgactatcagttaataaattggagatagtaagttaagatcattatttatattatggaaaaatgaagaaataggacatggttctctaactttttaatttttctgtgaaataaaatattatgacttattttatttttatctttgtttttaggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgaaggcaaggagagaatgtatgaagaacagtcacaggacaggtaagaagaatatttcagatgttttggtgtaaaggtcatttatgttgctttttacttaatagttaacctaaacgtcaccatgtaattgttttggggtaaatgtgagtcgctttgtatatagtcatgtggtacttaacgatggggatactttacaagaaatgcatttttagacaatttcattgttgtgtggacatgatagagtgtacttacacagagctagatggtattacctaccgcacacctaggctgtatgatgtagcctattgctcctaggctgcaaatctatacagtatgttactgtactgaatactgtgggcagttgtaacacaatggtaagtatgtgtgtatctaaatatacctaaacatagaaaaggtatggtaaaaatactgtataaaaggccgggcgtgg

SEQ ID NO: 213 - DNA, 2541 bp, Artificial Sequence
  Description of Artificial Sequence: Synthetic polynucleotide
agatgagaaaacctatccttcccaatttttttgtgtgagaattaaaatgcagcaagaaaacacacactcataaacacatctgctttggcaaaggagcacatcagaagggctggcttgtgcgcgctcttgctctctgtgtatgtgtattatgttttatgttactgtaaaagatgtaaagagaggcacgtggttaagctctcggggtgtggactccaccagtctcacttcagttccttttgcatgaagagctcagaatcaaaagaggaaaccaacccctaagatgagctttccatgtaaatttgtagccagcttccttctgattttcaatgtttcttccaaaggtaagcataagagtcaaagaagtcccaacccagctttccctgaaagtgactctcagtaactcttttgctttttataggtgcagtctccaaagagattacgaatgccttgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaaggtaagtgttcattcccttaattgctttatttcagtgtgggtgctatttggcaagttggaaaatagcatttctaatattccccagcgctgacctctgcctccaggggggctatacaggaaaccagatgcatgtctcctgccccagtggagactgtggtccaa

SEQ ID NO: 214 - DNA, 2541 bp, Artificial Sequence
  Description of Artificial Sequence: Synthetic polynucleotide
aggattgttctagttgattggtatgtgtgcactcctagttgttaaatattttcactatcacacctggatatactcaacaaatatttgttgagccaaatactcaacaccagccaaacacgtagtatttactttagcttaagcgaattatttagccctgacagaagccctggaatgtgggtctttaagttcctatttttgagatgggaaagctgaggctcacggaaggaggtgaccagctcaagtctcctaccgtccatgccaaattagaattccagcctgcctcctgacttcaagtccaaagttcttcccacgcactaaagctagctcttcagtgtcctttcttaggaggtacttcctcccgcaccactgaccgccccctctctatttcacccccagcccatccggaaaggccagcgggacctgtattctggcctgaatcagagacgcatctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgtt

SEQ ID NO: 215 - DNA, 2541 bp, Artificial Sequence
  Description of Artificial Sequence: Synthetic polynucleotide
aataataaaataataacaatacttaacatttattgagtgcttattaagtctcaagcactgtctgtacccaacacttatcaaggattctttttcatgtaatcctctcaacaactatatgggttaagtatcattttattcccatgagtaaagggatgaggaaacagagggtttgtgagttgaaaacacatttcacgcttctcacagctagtgagtaataaagctgggactcaaacccagggctgtttgactccagtgcctctacccacggccaccactctttgcttgtcaatgttgttctaaacatattgaagggggggctctgaccgtggcaagcgtgtgagtagtaaggggagaatggccttcatgcactccctcctcacctccagcgccttgtgttttccttgcttagtgatttcccctctccccaccccaccccccacagtgtgtgagtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggtaaggctgtggagtccagtcagaggagattcctgccaagggggacgaccagcctgggccagggtgggtggcaagtccacagctaggtcagaacagcttctctagagcttctatgcacagcttctattactgtgatgacaagatctcaacagacggtttcaaatctcacatcactcccctccttcccatcctagaaaagtgcaaaaaagtttatgaaagtgatgggcttcctcacatacctgtcaatgcctgcagtcatccgattccgcccctaagctgtgggaagagag

SEQ ID NO: 216 - DNA, 2541 bp, Artificial Sequence
  Description of Artificial Sequence: Synthetic polynucleotide
actgtgacccatgaaccagtaggtattggcgtcacctgggatcctgacgttagtctctgtcaatccttctctttagttcatctattctacccaaagtgatctcatcatctggtatgctgttagcagtttcttacctgtatagtatcttccaaataacatgccccaaaatcccaaagttttacccctactaattacagcaatgtctcttttattcttcaccccctgacgcagatattggcgtcacccgagagcatgttagtaatgcagaatctcccctccccagaactactaaatagcacctgaaattttaacaagatccccatgtgattcatgtgcacatcaaagtttgagaaacactactctaatgatctcctggtatgcagaagcagggagaatttcagaggcaagatccttaatagaaccacggcttttctcatttcaggaaaccactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaagtatgtaatcccctttggtctgtttgttgtgaaattaatcagtatttgctgttctggtgagctttttatctggggtgaaagtggaaatagatcctcaacagtaatattatcgcctgttctcttaatttcagcttgcctcttttaaaatactgtaagatacttccctcaccctattgaaaaactacagccagtcctgtaaaattttgtttacctttgggtgggctccatgg

SEQ ID NO: 217 - DNA, 2541 bp, Artificial Sequence
  Description of Artificial Sequence: Synthetic polynucleotide
ttcgagacaagcctggccaacatgatgaaactctgtctctactaaaaatacaaaaaaaattaaccaggcgtggaggcgcgcgcctgtagtcccagctactcaggaggctgaggcaggaggaccacttgaacccaggaggtcgaggttgcagtgagctgcgattgtgccactgcactccagcctgggcaacagagaaagactccgtctcaaaaaaaaaaaagagagagagagaaaaagaaaaaagacagagcctccatctccttgtcctctttccatcctcaggaccatgaagtacccactccaaattctcacatataaaaaacattcaataaacatgcatcaaattaattaatagaggatggaaaaaatgacttatgactgtgctgtcctttccagcccctcaaggatcgagaagatgaccagtacagccaccttcaaggaaaccagttgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataggaggaattgaactcaggactcagagtaggtgggttcttcaatgccaattctaataaaggacccttgcatcaactgccctcgcaattgcttctaagtctagctcccttccctaagcggctataagcatcagactctggggatcagggattgggacgtggtttggggtactcttttctaaaaattctggggccatactgattgtcttggcctaggtaaatatgaattttatgtatctgtaaatcctgtcagagcagggcctcaagccatagagatgctgaatattaatcttaacctacatttgaatttctcattatctacactattaacattttgggctaattaattatttgtgatgaggggctagcctgtgcattgtaggagttatggaagcatccctggcctctctccaccagatgctggtagattgtccagtgtgacaatcaaaaat

SEQ ID NO: 218 - DNA, 2541 bp, Artificial Sequence
  Description of Artificial Sequence: Synthetic polynucleotide
gacctcaggtgatctgcccgcctcagcttcccaaagtgctgggattacaggcatgagccaccacacctggcctaaaattaatttttaaagatctcttaaaaagcagacaccagccccaatctcagaccccttgagacagaatttccaggacaggggccatcctgctggacagtgggtgccgagaacaccttgcccatttatctgagctcccttctgactctgaaatctggagccccaccctcctgggtctagcttcggggctgcctgggtcagggtcctctgggaagcccctgcagtgccccagaagggacgaagctcacaaggggcaaggcaggcagcccacggggcaggagggagctcaactgggcgtcctagggagagggcagtgaggggtgccagtggggaacccctcccagcctgacccccaccacacctttctgacccccagattgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttaggtgggtaactagccagccacacgggcaccctgggcctgggcgccagccccgaggagactgcccgaggcctgtgatctagggtctgagcaggctggtggaaggggtggggggaccccagtttataaccactccccaagacacatacc

SEQ ID NO: 219 - DNA, 2541 bp, Artificial Sequence
  Description of Artificial Sequence: Synthetic polynucleotide
ggacaggggccatcctgctggacagtgggtgccgagaacaccttgcccatttatctgagctcccttctgactctgaaatctggagccccaccctcctgggtctagcttcggggctgcctgggtcagggtcctctgggaagcccctgcagtgccccagaagggacgaagctcacaaggggcaaggcaggcagcccacggggcaggagggagctcaactgggcgtcctagggagagggcagtgaggggtgccagtggggaacccctcccagcctgacccccaccacacctttctgacccccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttaggtgggtaactagccagccacacgggcaccctgggcctgggcgccagccccgaggagactgcccgaggcctgtgatctagggtctgagcaggctggtggaaggggtggggggaccccagtttataaccactccccaagacacatacccaggagggggactggaaggggccagcacccatctgtaggatggcaatggaggacctagttctgccaatcactgacttcatcgtcgcctctgaacctccattctcccatctgtgaagtggggtggtacttcccgcctcgcaggaggct

SEQ ID NO: 220 - DNA, 2541 bp, Artificial Sequence
  Description of Artificial Sequence: Synthetic polynucleotide
tgctgggattacaggcatgagccaccacacctggcctaaaattaatttttaaagatctcttaaaaagcagacaccagccccaatctcagaccccttgagacagaatttccaggacaggggccatcctgctggacagtgggtgccgagaacaccttgcccatttatctgagctcccttctgactctgaaatctggagccccaccctcctgggtctagcttcggggctgcctgggtcagggtcctctgggaagcccctgcagtgccccagaagggacgaagctcacaaggggcaaggcaggcagcccacggggcaggagggagctcaactgggcgtcctagggagagggcagtgaggggtgccagtggggaacccctcccagcctgacccccaccacacctttctgacccccagatttccaggcaaggctcacccgttccaactcgaagtgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttaggtgggtaactagccagccacacgggcaccctgggcctgggcgccagccccgaggagactgcccgaggcctgtgatctagggtctgagcaggctggtggaaggggtggggggaccccagtttataaccactccccaagacacatacccaggagggggactggaaggggccagcacccatctgt

SEQ ID NO: 221 - DNA, 2541 bp, Artificial Sequence
  Description of Artificial Sequence: Synthetic polynucleotide
tgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacg

SEQ ID NO: 222 - DNA, 2541 bp, Artificial Sequence
  Description of Artificial Sequence: Synthetic polynucleotide
ctacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaag

SEQ ID NO: 223 - DNA, 2541 bp, Artificial Sequence
  Description of Artificial Sequence: Synthetic polynucleotide
tcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatctgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagaga

SEQ ID NO: 224 - DNA, 2541 bp, Artificial Sequence
  Description of Artificial Sequence: Synthetic polynucleotide
tgagcaaatagttctatcctttttgacacattttccacagtttgtataatttattcatagaatccttcttagactactaataaattcctatgggacatagtccttttatatgcggaggaatccaccaccatgaaatgttcacaagaaatgacttttaaaattttatttgtggccatgctgattatgaatttctgaattatgtctgggctgctctttttctcggaatatgcaaagtgggatactggcatctctgtatctggagagttacagcttctgagttaaaagatgaatgggaagtagcaggagagggagagatcagaaatctccactccctgaaacacagacacttcacatacccaggaggtaaattcctggcatgaattgtaacaagtatacacaggcatttgtacattgtttgcttatgtgctagatgacatggcagtctatgaatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcaggggccccacatctgcaggcaggacattcagccctgtatcttgccactaccatgaaatctgaggttctttcatttttgtttttctattctgatgagattgaggtacactgactcactggtaaagaagacaatttatttgtgaacttgtagtcactccatttgacggcctccctctactcactgaggcacagcacgtgtggaacaggaaaaaggcctctggagagcttgtgttccactggtttctttgacttttgccaaccaactttgcaaatgttctcaaaaggcattcattacctctgcaggtgtgaaataactctgcagttcaagggtttgtgaaatcacgtgaaacagctgaaagctgttctggcaaagcgaccagagtcagagttagctgtcaccaagccacatcctggcttaaacgatgttatttatatctaactgcactcga

SEQ ID NO: 225 - DNA, 2541 bp, Artificial Sequence
  Description of Artificial Sequence: Synthetic polynucleotide
agatgcccattgtaccacctaccattgcttgacccccgcccatgagctgttccttcatactcataactaaaatgccaaatgtgtgacttgagtaattaactagagacctccagaaggctttccttcttattctgggtacattgatatttactttagtatttgttttgcctttaaagtcatgttcccttttgattctttaatatcatatccaaaacgaagtccttttaacctataacaatgcaaatcaaaagtgctgtctttcagctacctcaaggatttagcaagcgttcctggaaatctaaccaaccttttaaaaagtatttctatgggaatgtatttctgagccctaaattatggattttgaaactaaaatagaagaatactgtaagtgcaaaacttccagtagataacagaatttgcaaaatctctaatctcttgtatgtgccccaatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtagtactctctataggccattggaacagaacatctggcttaaaataatctcagcaccaaaaacggtctaactatggtctccacaacataacccgatggttctcatattttagatgcttgatgcacaagttgaactggctaacaattcagacttcaggacttgactcccctgggaatctgcagttgtttccctccccttgagtgagactgactgttgggagtagaataaccgcatgctctgggtcagaatgcctggcccttcagagtaacggcagccatgatcgctgagctcctactgtgaggcacatacttcgccacactaacacatggaatccttgcaagctccttacataatcagtattttatgcactttgcaaatgagaatactaaggctcagaagaggcaagctcctctcccactgttaaacagctagtgatgaacagagctggg

SEQ ID NO: 226 - DNA, 2541 bp, Artificial Sequence
  Description of Artificial Sequence: Synthetic polynucleotide
actcccctgggaatctgcagttgtttccctccccttgagtgagactgactgttgggagtagaataaccgcatgctctgggtcagaatgcctggcccttcagagtaacggcagccatgatcgctgagctcctactgtgaggcacatacttcgccacactaacacatggaatccttgcaagctccttacataatcagtattttatgcactttgcaaatgagaatactaaggctcagaagaggcaagctcctctcccactgttaaacagctagtgatgaacagagctgggacctaaacttgtctgatttcccacactgctgctccatcagattgtttgccaggttaaggattcatgccaggaccttaaatccctctgaatcgacagagctaacctaaagggcaccttgatttcaggttttgttcccaaacctatgactgtggcctggccacgttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataatgaagacccggttggttctagcttcacaatgagctcattggcattgtccccacaaccaccaccccctctccacctctgatcatccactatcatttctatatggcctttgccaggcttgtcctcatatcaaagcttctgccctctatgtttaaatgcataagcttgacaaatgttttcatttgagaaggcaagctgcctccccgtgcttggtctaatgtgagcttggtagagtgacactgctggattcagttttagtcatcaacacttccagctgatgctgatctgagtaattgtcctatttagactctgacaggtgaaagtcatagattcaggaaacggagactcccctcaccctgctatgaaggggagtttgagagggttgggcagctcttcccggcagtggcaggcagtgtggggacacacgtatggataaattgttaatgctctt

SEQ ID NO: 227 - DNA, 2541 bp, Artificial Sequence
  Description of Artificial Sequence: Synthetic polynucleotide
ctgcaggtggcagacttactcattctcatgcttcagctccaggggttcccctgtatgagtcttctctgcccgctcccacaccccaggtagcattgcccctgcttgctttgtgccctcactgtctccacatatatacacatctcttacaataatattaaataccagccaacatttatatagtacttcttatgtaccaagtactgttgtctatctatctatcatctatctatctatctatgtacacacacactcatattatcttcacaatgctatgaaataggtattattgctgtccattttacagatggggaaaccaatctataattggtttagtgagatttactgagcatatctacaggtatttgtccttggttataggaaaccaatctgtcactggtttccccttctgtaaaataagttaaataatttgcttaagctcactcagatagttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtgtggttgagtcataatctgagctactctctggcccaaactgcttattgtaaccaccacatcatatggccacttcagcaccagtcacacctcattttacttgttgatgtctcagttttcccctctattctgcgggctacttgagaagacttctgtcttcttcctctaggtatctctgtgcttgactcagtatcgagaccataggtgtgtgggtggggttaatccacacttgctgaacacatgtgtccgtgcccaatgtccctgtgcatagtggctacttcccatggttcacacgcatcttcatggctcttgtttcttccattcacccatcccatgtccctggccctgttctcagtgctgaggatggaacctcattgctgctgcttccagccctggccctgcccctgtttggggctcagtgcttcatcccgtggagctcaaggggtgctg

SEQ ID NO: 228 - DNA, 2541 bp, Artificial Sequence
  Description of Artificial Sequence: Synthetic polynucleotide
cttctcatcctcacacccattcatttcttagtttcccatactctgacttctactaccccaagttcataaagacctcatgaacacaacctggagaacgccctcagcctcatctcacctccctgcaacacatggctcacttgtctgcttcttccttcttagagtcctctctctggttgacctgtcaaagatgggattctcctgttaacgaccctgactcctttgtctccttctacaaagataatgcactgactttccaaatgtactaactagtatgatcatcactgtctactgttgcatcgaaccactactaacctcaatagggaaggcaccaggttcaagaggccaaagaagagacccagagccagcaaatgagacatggggttttatgaggggctcacatagaggggagagagtccagtggcagtgggctgggcaggagaaccaccttactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacgtggtccagtggtgggaggctggaaaagagatctgtcttgcctacagttcagtggtggcgggttgggcaggaaaaccacaactgcctgcaaacatcatgcagtttacataacattgtcacttagcagcctcccctaacgacctccacctggcaatcttcatttaacccaaaactcaaggcctcaatcccctgtatggaccatgtttcatgggacaggccaggggctcagaagtttatcatagataaggaatgaatctccgggttggccactcctggattccctagcttggaacacacattcaagtgtatctgccattctgagtgtattcttcaattattgctgtcaggtgtgttgaccctctatctacataagtatttctcaaaccagggccctacgatcagcatcagcatcacctggggtatatgtgaaaaatgcagctcctggacc

SEQ ID NO: 229 - DNA, 2541 bp, Artificial Sequence
  Description of Artificial Sequence: Synthetic polynucleotide
gggccaagcaagctctgagacaagctgtctcacctcctcatctcctgagcacaactcacccacagctctgccctcgcctccacctacatcatgccttcctgcatgccaacttccctctgaggttcccttcacccacttacaaccacagcctccttccggacctcccctacacgatgaacagtctgccagttaatatacatcaagctgccaccatgaaacagctcggaaagccccatttgttctcaatagcattccagctagaaagaccatccaccacccatggccactgaagaaggtcctcccctgagtgccaggcagtggggctcctaactctgggccccaattagcttagcttgggggagcaaaggacaggagcactgttcacccagttggactaacagctccacactgtgcctaataggaacctccttctcacaggtggcacctttgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgaatcagggtctgtcctgagccaccctcccttggagagatctgagcactgagaaccacagagcctgggacaccagcacagggtttgaaaaactccactcccagtcagctgcggtggctcatgcctgtaatcccagcactttgggaggctgaggtgggtggatcacaaggtcaggagttcgagacagcttgaccagcatggtaaaaccccatctctactaaaagtacaaaaattagccaggcatggtgttgggcacctataatcccagctactcgggaggctgaggcaggggaattgtttgaacctgggagctggaggttgcagtgagccgagatcgcaccactgcactccagcctgggcggctgagcgagattctgtctcaaaaaaatgggaaaaacatcattcccatgtgtgtcctggttgcttgtctctttcaaagtactgcatact

SEQ ID NO: 230 - DNA, 2541 bp, Artificial Sequence
  Description of Artificial Sequence: Synthetic polynucleotide
ccacatcatggaccagaagccacttggtctggttgtgaggatgacggaaccttgcccgaggaaatgggcaatgaacaggagcctgtttgtttctccttccagctcctgacctgtctagctcctgaccctctcagtgtcattcttgctcacccctggccctgctccctggatatgcagacaggatgggcttcttccctttagaccttcactttgctcttttggactcctcttctggccttgccttcccctggtgtcatctgctggctccctgcctgatactgccacactggtcatgctggcctcctggcctttggtgacaccgcatcagcaggctcctgcttccctgtcaagggatacaagccagcaccggtctttcgccacaaggtatgtgtgtaaagattgcttcctgtacttggtgtccacaggattttaaagaactcctggcccacttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcggaactctacgcttgaaacagaaacatcttctcaaaacacctctggtattggcccatttctctattactgtttcttgtggtttcatactgaggtttttggtgcattgcaattgccctggagtttatttttagtaataaagacagagttcaattaatgtcaaaacatgagggtaattgcagaggaaggattagtaagtctaggggaaaatgtgcccaactttttttcttctgataacatctttcactgatcatacaccgtcacacccacagacacggagcttcctccgtgatgtctgcaatgcactaggcccagtcggggagcagtggctgcgccaccacctgaaaacgaaagcatttctgagtctctttcagtccagctcatctagcagccagccacacaggtgaccacccaccgtagctgtcactatgggtgatgattatcattatgg

SEQ ID NO: 231 - DNA, 2541 bp, Artificial Sequence
  Description of Artificial Sequence: Synthetic polynucleotide
aggatctttctctctacagtgcctcttgtgggacgggttctgctgatgggggctgtgtttgggatctcgcctggaaacacgatctctccaactttccctgggagcagagccttgggtctcactgaacccacctccccagcaccttgtgtggtgactggcaggaggtagccattccctcctgtcctctctgcccttgtccactttcctgttatgagtcagttgctgagataggctatgaggagttaacagagtggataaaaaagagctttgtccttctttaaagccttcaaaatatacagatgtattagtcagggctttccagagaaacaggaccaatagaacatgaagatagatgcgtatccatgtctatatcaatatctaccttgatatttatatctatatctaggagatttatttattataaggtattggctcatgcaattatggacctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagaggggtcctgtgatttgccacctgcaggctggagacctaggaaacagctgtcgtgtcacaaagggcagagggctggagaacctgtagtgtagattccagtccagattcgaaggcctgaggaccaggaatgccaagggcaggagaagatcgatgtcccagaacaagcaatcaggcagagatgaaattcaaccttcctgtgcctttctgttctattcaggccttcagtgggttgaatgaggcccaacccacattgaagaggaccatctgctttactcagtctcctggttgaagtgataatctcatctggacatactcagaaatgctgtttaaccagctctctggaaatcctgtggcccagtcaagttgacacacaaaattaaccatcacactgcagagacacagtctatcccaatacctgtatttactgggtaacgtgcatctcagctc

SEQ ID NO: 232 - DNA, 2541 bp, Artificial Sequence
  Description of Artificial Sequence: Synthetic polynucleotide
taataatgactctgctggtaatttgtgtccttctgcttggaactgtttcctttttagtttggtcaccctcccagagctggtttcaatgggggcatacccattatgggatgcagggcatcctgcatcctgaggaattttttttcctccaaaaatgaaaccttgaaatgaggacattgtcctgtccacggactgcacaacaacactgagcctcaaggactcatactggcatttttcttcttttgcagagtgtgggcaccctggcttcaagctcacgagaaaccaggtcgggatttaaacaatgttgggttaaagcaaagtttcataaagacagaatcaagaaaaaaagaaagagaaaccaatctaagtgccatcctccctgagttgcatcttacctgagtcttcagccgccgccccctgctgctgtgggaggaaacgggaaagtgactggcctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatatggggacaggggtcgggggtgtgagggttagtggtagcagggaggtagcacttctgtgaagccggaaaggagacctgaacctggctctctgctttgctgcttgccagccctctggctgggaagaaggctcttggctcttgtgagcctcggtttcctctgcagagtggcctgttctgaggacaggctgacattgctgtccatcagtcttccaggaccctgaggatttcagctctacccatgggcactgaactggaacattcactggtcatttgctttcgttttttttttttgtttgtttgttttttgatacagagtttcactcttgttgcctagggtggagtacaatggcgtgatctcagctcaccacaagctctgcctcccggggtcaagcgattctccccagtagctgagattacaggcatgcgccaccacgtccggctaattttgta

SEQ ID NO: 233 - DNA, 2541 bp, Artificial Sequence
  Description of Artificial Sequence: Synthetic polynucleotide
aagtcaacaacaggctccagaaaaaaatggaaatataaatggtccccaatttggcattttggaatttgaggcttatatagtatgagcaaaataaactcctcctgcttctatgaattctttgcactttttctctataattccttatcaagcaatgggtttgtctgttaaccaagactatacataaaatgtattcccgtagttccttttattacattttttctttgttgttactagtggagaagctaacaagagcagaatttcctgcccaaccgtagcaaatacagaaaatcaaaaagagaagctttgatacagccagtgtagatacagctaggacgtcatgaatcagagctcccacacacgatgataatggaaacatcttatccatatctgatttgctcacatatagttatttagacaacaaattttacattcctggatagggagcctccgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatatttgatttcaatctcatagtccaggtaggtgtaaaatgactgccaagccagcagacataaatctgtattatctcattttcatcacagtctctgcattgggaaaaaaatgtgagtgaaaagacattttctcccaccttgttaagtacacaattacatagtttaaagaagataagaatttcaaattgttagaatgatatcattattcaaatgattccctgagaacttcaagtattccccttcccccaaatgtaggcagggcaaaatagaaccagtaggaatgaaaaatgttaattgtttcaggttctgtaattttgggtttaatgactcaggctatgtgctactgagtaaaatactcatctggagaaaaagactgttgcatgacatatttctgattaaggacaatttaaactaattctaagaaaactcttacatactgcacatgccataaa

SEQ ID NO: 234 - DNA, 2541 bp, Artificial Sequence
  Description of Artificial Sequence: Synthetic polynucleotide
gattaggtctggaataagattgcaccatgactaaaatgacttctttagccaatgacattcctgaagattggatcagagtaaagttaaactaacctactcaaggaagactttcctaaatcagcccctttgctgtataatttagtatggagagctgattgtgggtttttcttgtttcattgtttaatacatagaggtttcacatttcattttgaaacagaaagagggactggaagagataagttagtatgagtgaggaaaagattagaaggtagagataggatcgcaatgctgttatcacctttgctttattgataatctcaggaaggactagactgctaagaaagaggagcccagattggaataaaagagacgatgccaggatcagcctgtgagaggatgtctcacttagtacacctcaaggatcatgtcagctgagcatctataccccgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtgatgaatattgcatacagactctgccttcaagtcatcccccattcgacaagcatttatttaaggttcttacattccaggacttgtactagatgctagaaacaaacagataaggaaaacgtaggaaaatgcttctctcaggaagcaatattgtatatgagtggtgaagagcttcaaatctggggccaaactgctgggtttgaaatttggcttggccacctactggctgtgaaatcttgggcaactttcttaatcactctgtgcctcagtttcttcatctgtaaaatgaaatagccatagtacttattacaaataggtaataattagtgagaattaatttgagtcaatacataaaaatgactcagaataaaagaccagctaagaatatatacacacatacttagctacttataatctagtaggaaagatgggtatgttatcagaggactt

SEQ ID NO: 235 - DNA, 2541 bp, Artificial Sequence
  Description of Artificial Sequence: Synthetic polynucleotide
cagataaaaaaagctgaagctcagggatattgtcatttacccatgagctcacaggcaggaagtggtgaaactatcattaaactacggttggccttgttcttttgtggtttcatttcactaagcctctgacaccctgacctcaacttccttctgtagatatgtcacctggcctccttcagtctaagacactacacactggccacacactttgtcatcctcatagactgacaacctgctctcacataccctgctttcttactgtgtaggctctcttttcttgctcagaatgtccttccccacttcttcatgtgccaactcctagtcatcctacaagaaccacattcactttaagtttcttttgaagccttttcagtgtcccataccctgatcccattacctcttctatgtatgcagggcttgcttcatgcttgtgtaacccaagggccctgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatatttgatttaacacattttaaaattcttaacaatttatgaaaaaggaaacccatatgttcattctgccctggaccctgcaaattatgcagccaatcctgtgtgtgttttttcatgttgcgtagactctattacagtcagtaacatattgagaaagagtgtgtgtctcctctgatagtctatgagctccttgaagcaagaggcttgtcttagtcattgctgtatcctcacaccagactctacgggatgctcaggattcacctgttgatctgtgaggaagcccaaggctcagttaatgccccccaccctccttccataacagtctcctgattaggaaacagtgcttgacctctagacaatctgagtatccactccaggaagtggaacattgccttcccaatgttgaaactgttagcactcaatcatgtttcaggaacatatagaaggtatgt

SEQ ID NO: 236 - DNA, 2541 bp, Artificial Sequence
  Description of Artificial Sequence: Synthetic polynucleotide
tggaccttatgcagggtaataaaaaccaacacgtggggcctgtgctgtaaggtggcagagggcgatgactcaccccactcatgcaggttgagtcatttcaaggcagagttgtgccagttcagtacccagtaatattttccagtcgacgagtatcagtgaacaggagataaccagtcatttctagattctgctcagagtcccagcttagaggctccaccagctcaaagagacgggatggcaaaacagccaccttaatttccagatcatctgccagctcatctgccagctgacacacagcccatggctccactattgccagtgctgtagctgcaccagaccaatctggttcaacttttatgtaacaaagttgtgatttgtttttcagttgcccgggactcccaggttgaagatcatgagcatgccctgatgagccaaggcatgcaaccacagtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgggaacctaagtgcttggactgaggagtggggactgaaataagaagcggacactgcagggcaggatcaggatccaatcagatcgagccctggcatcacctcatggcaggatctagtcagatcgtggcttttgacatcacttcattgtgaaatccaatcagatcacaccttattaccctatccttataaaaccggacctagcccccagctcgaggaggcactgctttgggagttatcccaggtgttcttgttactagttgcaaggaataaaatcctcttgctaaatcctccttggttgtgcagatgttggcatggatgtggagagaagggaacacttacgctttgttggtgaggatgtaaattagctcaactctgtgataaacagtatggagagttttcaaagaactaaaaatagaacttctactcaacccagcaatcctatgagtgcatg

SEQ ID NO: 237 - DNA, 2541 bp, Artificial Sequence
  Description of Artificial Sequence: Synthetic polynucleotide
acatctaatcccacaccatgactaataaacatggcatgctgcaatgggcattaatttatgggtaacagaagcagatccaagccttttagctaattaaataaaaatgcaccatacagcaaccatcctgcctgcttgggtgtaaaatagagaggagaaagatggcatgctggtcattgagagataattacctgcaatttcagagctggaatctagtgacaacataagaaaaataataacctctctggctgttaggattctcagttctagctgcgagcaaggagcaaaggcacccacagacttgccaaacctatgtcaggaatgacgaatagaaggcagaaatccacatccccaggtggtaaaattgttatccaccttcgtcacctctttcctaatggaggaagtgaggacaggcagccttggagtcctacttgaatgaggcctggaccttattgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgcagggtaataaaaaccaacacgtggggcctgtgctgtaaggtggcagagggcgatgactcaccccactcatgcaggttgagtcatttcaaggcagagttgtgccagttcagtacccagtaatattttccagtcgacgagtatcagtgaacaggagataaccagtcatttctagattctgctcagagtcccagcttagaggctccaccagctcaaagagacgggatggcaaaacagccaccttaatttccagatcatctgccagctcatctgccagctgacacacagcccatggctccactattgccagtgctgtagctgcaccagaccaatctggttcaacttttatgtaacaaagttgtgatttgtttttcagttgcccgggactcccaggttgaagatcatgagcatgccctgatgagccaaggcatgcaaccacaggggaacctaa

SEQ ID NO: 238 - DNA, 2541 bp, Artificial Sequence
  Description of Artificial Sequence: Synthetic polynucleotide
tgaggtcttggtatgttgcccaggatggtctcaaactcctgggctcaagcaatcctcctgcctccacctcccaaagcgctgagattataggcatgagacacagagcccagccactgtccgcatttctttcctggcttccttactgggttctctactttcactcttgccttcttcctctcttccaccagcataagttttagaaactgcacttctgatcatgctgctctgctgcttaaaatccttcatgcagatcatgtaagaccttcctgatccagtgctgccttgccctctagaacccagggtgcctttctcccctctgcagttctactgcgccacctgcagtttctctctcctgtgttcatgtgtctactccctctgaatggtaggctcacaccctccacctggccaactcttactaaatcttgggcttcaactcaaggatcaccttcatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattggttcactccaccaggctgggctgtgtgtcctgcccagttcctatagtgccctaactcacttttttaaaaaaatactttaagttctggggtacatgtgcagaacatgcaggtttgttacataggtatacacttgccatggtggtttgctgaagccatcaatgtcatctacattaggcatttctcctaatgctgtccctcccctagcctcccaccccccaacaggccccagtgtgtgatgttccccttcctgtgtccatgtgttctcgttgttcagcttccacttatgagtgagaacatgcggtgtttggttttctgttcctgtgttagtttgctgagaatgatgctttccagcttcatccatgtccctgcaaaggacatgaactcattcttttttatggctgtccattattccatggtgtatgtgtgccacattttatttatccagtct

SEQ ID NO: 239 - DNA, 2541 bp, Artificial Sequence
  Description of Artificial Sequence: Synthetic polynucleotide
ccttccacccccttccttaatagttttcctcctccgcctcctgcacggcctccgcctccgcctgaccgtcctcggaaacctcccagccgcagcccggccctccccagcggcctgagtggcctcctcccgcggcgccccccagctccgcacctccccagccccgcccgaggcgcgcccagcgagcgtgaccccgacccagggccacggctgcgcccgtaggatcgcgggcgcgcgggtctccatgagggactgggagagatgcgtcacccgctaatccctcaactgggtcgcacccggtctgccttggttggtcccttctgatggcggaggcgggacctcgacttggtggccaatgaggagcctcgtgggggtgctctcggctgccatggcaacggaggggccgcccgcttccccgcggggcgaggccggctctcccaggactggccacattgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgcagtcacgcgctgtggccccagtcctgttagcatgaggtgggggtcagaagttgaggaacaactcggacctaaagccttgacaattgccaacagtgtagacaagtcccagcatgcccaaaatttataagagaaggctgcctggaagagggacacgatgaggagggtctgctgaaacggacaaagaaacccagttcagtgcagtggagtggacatggcacgggcagggcacggagtggggtcggtgcttagtaagcggattagggtttccaagccaagacccacccagggcaggatggggaaccaaggtgagcaggtgcgctgaattgtgggtctcacactgtccttcagtgtcccgcaggaagagagagctaaggatcaccagggtcattcccctgcctcaggcagcctgcactccaccttaggtacagtcatgtccggtcttcagca

SEQ ID NO: 240 - DNA, 2541 bp, Artificial Sequence
  Description of Artificial Sequence: Synthetic polynucleotide
tgatcctcccacctcagtctcccaaagagctgggattacaggcataagccaccttgccccgccagtttttagcctgtcagctctttgagggacacttgttatggtcatacccacagctttgacccttaccaggtggtcaggtggatgaatgaatgagtagaaagaaggaagagaaggcaggagggagaagaggaagaatgaaggaagggttgagtttgttctggaagctcccagcttccatccgcaccacactctccctctgtccccaggacaccagggaactgactcaaggctctcctcttaccaggtgctgtgtggggtccagggagaagagcccatttgaaatggggcactggtctaaactctggacctgctgctcactattgactgaacttagccacttaaatattctcctctataaaatgggagtgaccatagcaactacctcgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgaattgtagggagacccaaaaaatgtatatgaatacatttgtcaactaaagagtgttagggattatctcagtggagggataggcagtgcaggctctggaaccagacttcttgtgttcacatccctgctccactgcttggagacctttggcaaggtccttaactcctctggacctcagttttctcatctgtaaaacagggattatactagttcctacctcacagagttgtgaagattaaatgagataatgcatgaaaggcttttcaataagagcagggcacacattaggcatgatgtccatgatcaagtgcctaatatgtgcctgctctcaggaaggatgctgtgaactacttcacactaaagtgtaaatgaatgataagatctactatgctccactcatgcctgtaatcctagcactttgggaggccgaagcaagtggatcacctgagg

SEQ ID NO: 241 - DNA, 2541 bp, Artificial Sequence
  Description of Artificial Sequence: Synthetic polynucleotide
ggtgaggtcaccctgggtacctggagttactcagagtgacactagtacacgcctggcaggagtgatggatgagctaggctccaggaaagcaggtggggctggaaaccacccaagacaaggaaattgttgggtttgaaattccaggtaagcagagtatggcctgagagcagcggcagaggctgaaagtgggcttggtctcggtatttttgaggctgaggtagctccaactctctccctctgagtcagcaccccacttaagacagaaatactgagatctgcgaccccagcctcccccacagcaactccacagtccccaaacctttgctccgctgggtcctcccaagtatggtagctgacacagccctgagcagcccactgtcctctgccctgccaagtcttctcactcttgtcactttgtcctacatcatttctttgtctggcacccctccttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatagaattggtgccccagaggtgggaaaaacctaccctgctcactgctctatctcctgggcttagctcagactctggcatacgtgagtgcttagtagaaacttgatggggtattaaaattgagacctgggtgggttctcacattaaatttctaacactccttaggtggcttgggcccacccctctgagccctgtttccacatctgtaaagtagcaaaccatcgccatgaagaacagggaagaaccaggtcagcaggcagggcggatgaagcatccagccagttctaggaagtttccgatggctaatccttcagatgcagcttgtaagcaggtcaaatacagaataggaaactgaggcgcaacgaagtcatgcttagaagtctgtccagggagaccagtcaaggcctcccccacaccctgcaagcccttctaggagctctggttaagtcactc

SEQ ID NO: 242 - DNA, 2541 bp, Artificial Sequence
  Description of Artificial Sequence: Synthetic polynucleotide
atcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgc

SEQ ID NO: 243 - DNA, 2541 bp, Artificial Sequence
  Description of Artificial Sequence: Synthetic polynucleotide
ttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtcttttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccaggggga

SEQ ID NO: 244 - DNA, 2541 bp, Artificial Sequence
  Description of Artificial Sequence: Synthetic polynucleotide
tggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaactttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgcttt

SEQ ID NO: 245 - DNA, 2541 bp, Artificial Sequence
  Description of Artificial Sequence: Synthetic polynucleotide
cgaccaacccatcaaactccccgcccccagcacttttatttctcctctttaggaagtacacttcagtatctttggcacagtgcatgagcacgactaaagtaaaacatcgcagaaaacatagctttagtctacccttcgtgtcctaaaaggaaaaccagtagcttcccaggccaccggaagggcaacacatgtcctctgcagtttctgcacacgggaaggtaaagacagagagaggacctactcctcaacacagaaacatttcaaaatctttcctcgcctgcaacccaagctgaagtcattctccccagaaataacaaaagttggaagagaagccggagacaggataggtgcaggaagcccacactttgagggcagcactcagacaccctctcctgtgtgcaggacgtgccgaatgttcaggtgcaatgagaatgagccatgcttggcttatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcgagggcaatctggcccatcaagtggccttcgcctctgggagtaacaaaaatgcacttcaaaatagcttctgtaatcaagctgcatgggtggagtactccccagctgactccaggaagttctctatccaaagctattcattaggccagagctgtgcaaataattagtcacccacttgctccataaccctccatgacagcccaggcattgagtccaggtgggaccatcaagccatgctctggtggctcatgcattatcatagaaatgggaggctttatttattttactaaaaagaacaaaaacaacagactgctgtcctttagacaataggatcacgtcatctgagccctctgtgccccaggtgacaagcccagccccaagttctctttcctcagcctccccacacatgttctggaggagatgggcccagcaggctgctctgaggcctggc

SEQ ID NO: 246 - DNA, 2541 bp, Artificial Sequence
  Description of Artificial Sequence: Synthetic polynucleotide
tcacagaatcttgtttgagctaacaaccagttattctacccaaagtaaagagtaacttaaattttcccattgttcttccaggctggaagatgtaagaaacacacacagtatagtgtaggtttcctccatagttaagtaccccagagctaggctgaaatccagtgttggattgtttccaacttatagtagggaaccgccaatgacatgaaagagcattaccttaccggactgattcatattctacttccagtcatagtacaaatgatcacatgtccacacccacatgtgctctgataagtagtcaattgagaggagtgagtcagggagccgtaactttgcagccaacctgccaagaagaactgatgcttttagaaattcagcagctttcattggcatagaagtttcagccttataggcccagggtttctctgaggcagaggcaaaccctgttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgttatgttgttatctcaggattcttttttttttttttgagacagagtctcactctgttgcccaggctggagtgcagtggcacaatctcggctcactgcaagctccgcctcccgggttcacgccattctcctgcctcagcctcccgagtagctgggactacaggcgcccgccaccacgcctttctaaattttgtatttttagtagagacgggatttcaccatgttagccaggatggtctcgatctcctgacctcgtgatccgccgccctggcctcccaaagtgctgggattacaggcgtgagccactgcgcccagcctatctcaggattcttaatgtaaaaacagttcagtatggaaagcgtacttatgacagagctgttgcagaatgtgaaatcacccatgtgcctaagtgtctccctactacctggaacactagaccacatgcagcag

SEQ ID NO: 247 - DNA, 2541 bp, Artificial Sequence
  Description of Artificial Sequence: Synthetic polynucleotide
cagccctgaactcagccttcacggccctccctaaacacatgggccagccacagggaagaaaaaaatgccctgtagcacaggaatctaaaacattgctgttgttctagttaataaaaggacttagagattgaaaagaagtaccatctgtatggctggcaacagacagcatgattttgatgactgactctggggagatctgagaaaacagtacataatatgtccttacctctgctccatcattcatgacccaagctcctgccctgtcttctcaggaagattcttacagtaactccagtttggaattcccctttcatatttgaaataacaacagtaatagtgaccactaatgcttaccgagtgtccactctgtgccaagcatcgtgtttttatcatcttttttgttaggcactgtacatggattaatacaattacaacccaccacaaccccattgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgagataagtacttgtactatcctcattttatgggtgatgatacaagaaacagaaaggttcagcaacatgcctaaagccacacagctactatgaggcaaagtctaggtttgaactcagaaattctgacttcagactcacttatcttattatacttcacttagtatctcccattaattaattcattcattcttccttttatttgttaattcaccaaatattctgggaagctacttgtctagacactgtatgaaaaatgagaatggatacaaagcaacctcagacatgaactcaaggtccttacaagcttaaacgtatatgatacatttccaaatagcaatactatgaggacagctgatactcacaacataagtcttggtggtcacaggagatctatcataggatttcacgaagaacctgacactgaaaaccagaacttgagggaaataaaac

SEQ ID NO: 248 - DNA, 2541 bp, Artificial Sequence
  Description of Artificial Sequence: Synthetic polynucleotide
gtgtccatcctgcatgtctcaagtcacaatcctccagatattcaaccaaagtgcttgattctgttggcacaaggaccatgaaatcttcagtagctaaggagactctttgacaaatagatttattgcatatgatgtaaaagggtctcattcagagaactacacatttactacacatttactagctgttagatgtgagaaattgaagctttgagaattgtcattttgtaagcacgctgtaataattgtgttctctacaaaaatggagaaatacttaatctttgcaggtttttattagcttcgaaaaagggaatacaaatattttgatacctgactttattttaaagatactggcaagcaaggaaagatactcagtttgctaaattatagcatagatttgaaagacggaaatttttttttgttattttgattctttctgattcagaacctgcgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgagtttccattcctgggatagagagccctgccaaagccaactcagtctcctgttattgcagaaatttaaaggttacttgagctgattgataccaattaaaataaaagcatctactgccattttattaaacgccctatttaatctccacatcccaagttcattctctctctcttttaaggctatacatgggcctcaacattctctcttcttcagtatcagctgtcctcatccctattcaaagtcagaatgacttggaatctattcagggctgctacttaattggatgaagaaagtactctgttgcatgctaacctcccagatttgaattagaaccaaggtcctgaatctacacaagacctttttccctttcctttctgcatttatttcttttttttctacatctttctttttgaatttttttttttttttttttctgagatagagtcttg

SEQ ID NO: 249 - DNA, 2541 bp, Artificial Sequence
  Description of Artificial Sequence: Synthetic polynucleotide
atcatcaaaatcttcatttatacaaatcacgggtattagaaataaaatcaggtattgtgtacagtcagatcccaggtttacacaaactagaggtttcaattaagtttccttcattttataaaaccatgacacaagctgtaaataaaggagctctggctttaggccttcttctgtttatagacagtaaattttaatcctctgtccctgcagaccaactcaaagcagtaaccttggctaccgttgccgcagaagaaacacaccctgcagatttccagttctatattcagtcttagaaaattggtcatgttgaaagggaaaaaacaattttactttgcctcagttattgacaccaagaagcactcctcagcctgttcagaggggaaacaatgagtcattcatgctgtcagcccaggtggtgcatgaattccagacagaggccgctgaattaactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatccgtggaggcgtctctctgagcagagcccgcaatgcgcctgcttggggctccctgcagcctctgggggaggcagggcggcccagagcaggcctgtgctggaaaggaacgcgaagccctgtaaccaagcctgtacctctgcagtgctagtcccaaggggcctccgagctgtttgtcaccatgtgattggctcaggagaggggtggagaaatgaaaacactctgcccaggatatatttagttgaagtgcagctggggaagtgcttaaacaagggagcttttgtccttatgttgaagtgtttttcttaactcctcaagggtgaaaaacttgagccacgtactgatcccattcccccccaccacccccaatatattttctcttctttaggaaatgctcttattctgaaactttagaattttctagggtttgttgcataagaggaaactgaataa

SEQ ID NO: 250 - DNA, 2541 bp, Artificial Sequence
  Description of Artificial Sequence: Synthetic polynucleotide
ctttcctttctgcatttatttcttttttttctacatctttctttttgaatttttttttttttttttttctgagatagagtcttgctctgtcgccaggctggagtgcagtggtgtgatcttggctcactgcagtctccaactctggttcaagcaattctcctgcctcagcctccgggtagctgggactacaggcatacaccaccatgcccagctaatttttgtatttttagtagagatggggtttcaccatagtggccaggatggtctccatctcttgacctcgtgacctgaccccctcggcctcccaaagtgctgagattacaggcatgagccaccgcgcccggcctctttttgaatttttttaaaaaaacacctaaagtttaggaaagtataagaggccaaagaaacaagagttcaaagaaacaagagtgttatacacgcacacttgcatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgaaaggtagtaaaatatctgtatagttctggctgtcaagcttttggactgagatatgcgtaagcaaggcaaaaagatcccatagtccaggaatatcaaccagtccagtttcccaaggaaactaaaagtaactgaaaatgagaagggtgccatataggaaaattgaaggtggggcataattattaatacactgctttggaaatgctggtatggaagattcatatatggacttcaaagcatacatgtcttatacttagctatgggaaaattatcatcaaaatcttcatttatacaaatcacgggtattagaaataaaatcaggtattgtgtacagtcagatcccaggtttacacaaactagaggtttcaattaagtttccttcattttataaaaccatgacacaagctgtaaataaaggagctctggctttaggccttcttctgtttataga

SEQ ID NO: 251 - DNA, 2541 bp, Artificial Sequence
  Description of Artificial Sequence: Synthetic polynucleotide
tgtcttcacggcacggcccccgcttcaccagctgcactgtttgatgagctttgcaggtcccagatcttataagctcatggtgattgatccaaatgatgcagaggtcggcctaaagttagaagtgggcccctctctgccccaagacagcccttcaccccaattccattcccacagtttgggcatccacccaggctgccaagccaagcgggggctgcccgggttagcagggacctggccatgggcctcctcagctaggggccgcctctctgaggagtgggtgccccgcccctccgtgggccgcctggtttctcttattggcagcgtctgtagtcccctggctctgtcacccgcagctattctaggcctctggttcctttcactttctgctctgcgtcttcctgcctcggtggttccccaccatccagcctgagacctccccgttgcccgccctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgggtttctgtctgctcctctccgtggtggccggccctggctctgccccaaagccatggagaaggccaaatgcaggctgtagaaaggtctgggatcagatccccccatccttccatggccacgtgaccgggcccgcctcttccctctgagcctcacatcctcatctgaagagggaatgctgctcatgcccaccttgcggggatgtggggagggggtgctgccagtggagactcccaggggaccctccaggagtctcatcctgactcgagactgggcacctggtgggggcacaggccccctctcccgccatgggaccgccacatccaggctctcgtgggttgagatgctgaggaaaggaaagaacaaaacctgctggaggagcagcgaacacggccctcagctgggtgaccttgggcaagtcacttcccctctctgggcctcagtttccat

SEQ ID NO: 252 - DNA, 2541 bp, Artificial Sequence
  Description of Artificial Sequence: Synthetic polynucleotide
ctgaagagggaatgctgctcatgcccaccttgcggggatgtggggagggggtgctgccagtggagactcccaggggaccctccaggagtctcatcctgactcgagactgggcacctggtgggggcacaggccccctctcccgccatgggaccgccacatccaggctctcgtgggttgagatgctgaggaaaggaaagaacaaaacctgctggaggagcagcgaacacggccctcagctgggtgaccttgggcaagtcacttcccctctctgggcctcagtttccatatctgtgaatgaggcagctggactgaagaatagagagtcacaaagcagagtgacacaaactgggctacaggaaaccctggaggccctcgacccaggctggggccggggatggttctgcaaagcctcttgggagagggttgcctgagctgagtctccaaacagaatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagtggccttaagtcacgggagatgagccagagcagtccagagggcacggtcagcacatgctaaggtcctggggcacagagtacagggcttgagaagggttcctcttgctccatgtgactttcatcatccaacagcctgtggtggcacttgcctgtatcccagctatctaggaggctgaggtgggaggattgcttgagtctgagaggtcgggcttgttctcccggtgttggcagagtccagagggagcaagtggaagccacaggtgtcttgaggcctaggctgagatctagcacatcaccgcgtcacttcatcccttcatttcatcctattggccaaagcagcccaattctagggatggggatctagactcaacttcttgatgggagaagtagcaaagtcacactgccaagggcagggacacagggagggatgaagagttaggaatggtt

SEQ ID NO: 253 - DNA, 2541 bp, Artificial Sequence
  Description of Artificial Sequence: Synthetic polynucleotide
aagccacctccctgctctgttgctggctctccttgaagacaagtgtttttcaattaaccaaagcggtgcatggcaatgtgataggggaatgaaacacagcaacagaatcaatgccccacgctgggcaatagccgactttctgttcgctcccatcccttccttccctccccgcctccttcccctgctccttccattccacaaacatttattgagcacccgctgtgtgccagccactgttctaggccctgaagacacagaagtgaacaaaaaaaaagagtccctgtgcacatcctggagggactttccccgtgtgtgtgtgtgtgtgtgtgtgtgtgtgtctatacagtgtatggagacagtggataataaaagctgtttatgaggcactttctctgagctgttccatgtgcttcacttatactcattcagctaatcctcaggacacccccgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgaagtcagtgatattagtcacagaggcccagagaagtgaagtgacttgcccaaggtcacacagccagcaagaggccaagcccggattgaaccccagccgcctggctctggagcctgcagcataaccacagcagggaactgccaccggagacagacatcgacagccactaggagatgttaaccaacaggcttgtcttcacggcacggcccccgcttcaccagctgcactgtttgatgagctttgcaggtcccagatcttataagctcatggtgattgatccaaatgatgcagaggtcggcctaaagttagaagtgggcccctctctgccccaagacagcccttcaccccaattccattcccacagtttgggcatccacccaggctgccaagccaagcgggggctgcccgggttagcagggacctggccatgggcctcctcagctaggggc

SEQ ID NO: 254 - DNA, 2541 bp, Artificial Sequence
  Description of Artificial Sequence: Synthetic polynucleotide
gggggcggccgcacggctagagcggagaccccgcgccccctccgcccgcgtggcccggccggggtgcggggcccggggaggcacgggggctgcgcgtcggggcgcagccgccgcccgcgtgtgctcggaggccgcggggcccgggctccggggtcctcccgacctgcagccccagcggctaccgcgcctcgccaggccaggccaggccccgacgtcgccttccctacgtcgccggcgcccggccacgacgtccctcagacgagccgaacgccgaatggccccgagcacgggaagtgcccgccccccgcgtgcagccagccaatgggacgccgaaagcggggaggtgccgaggggacgtagcgtcgccgcgccaggtctctagcagctgccgctgagccgccggacggacgctcgtcttcgcccgccatggccgagagcgactgggacacgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtgacggtgctgcgcaagaagggccctacggccgcccaggccaaatccaagcaggtgctttgctgactgaggagcggccgggccgggcggggcggacgctgggccggggccacggaccgtggggcagggggctcggggaagggcaggcggggcctgggacagggcgcaggggacggggacaaggctggggtgccgggggcaggacggggttcgaagggcggggcgaatcgcaggggtaggaggaccgggccaggacaggggtgggaaggtggggggcggacccaggaggggatggacggacccaggaggcagggggcgggcgactggaggaggagaggagcagggaaccggacggggcaaggggcaggcgatagggccgggaccagtgccagggtggggcggggaggggataggggcagggactgttggtggggacaggtgtgaggacag

SEQ ID NO: 255 - DNA, 2541 bp, Artificial Sequence
  Description of Artificial Sequence: Synthetic polynucleotide
acggctagagcggagaccccgcgccccctccgcccgcgtggcccggccggggtgcggggcccggggaggcacgggggctgcgcgtcggggcgcagccgccgcccgcgtgtgctcggaggccgcggggcccgggctccggggtcctcccgacctgcagccccagcggctaccgcgcctcgccaggccaggccaggccccgacgtcgccttccctacgtcgccggcgcccggccacgacgtccctcagacgagccgaacgccgaatggccccgagcacgggaagtgcccgccccccgcgtgcagccagccaatgggacgccgaaagcggggaggtgccgaggggacgtagcgtcgccgcgccaggtctctagcagctgccgctgagccgccggacggacgctcgtcttcgcccgccatggccgagagcgactgggacacggtgacggtgctgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcgcaagaagggccctacggccgcccaggccaaatccaagcaggtgctttgctgactgaggagcggccgggccgggcggggcggacgctgggccggggccacggaccgtggggcagggggctcggggaagggcaggcggggcctgggacagggcgcaggggacggggacaaggctggggtgccgggggcaggacggggttcgaagggcggggcgaatcgcaggggtaggaggaccgggccaggacaggggtgggaaggtggggggcggacccaggaggggatggacggacccaggaggcagggggcgggcgactggaggaggagaggagcagggaaccggacggggcaaggggcaggcgatagggccgggaccagtgccagggtggggcggggaggggataggggcagggactgttggtggggacaggtgtgaggacagaggcaggaggtg

SEQ ID NO: 256 - DNA, 2541 bp, Artificial Sequence
  Description of Artificial Sequence: Synthetic polynucleotide
ccctggagtcggtgtgaggcaaaagcagaggagaggatttggaattaacctgaagaaaaaccatttcaaagcggtaaccagaccccagaggctgcctgaactcaaggggacatgggaacccaggctgtcccaagttcacacacctcaggtcgtggacttccagagttttctctcagttatgaggacaggcagctgtactcatgccaaccagagctgctctgggaagatggctgcctcccagggctccggccagcaccggtgcaggcaggcactcagctgacaacgtccccgggggcgccgcacacaccacacccaccagcacatggaccccacagcacagcctcatgttgcaagcggaaacacaagtacctacatttcttggaagtctccacatcttctcctcgtctctgtgccgctaagatagcctagaaaattagaaaacatcagtggtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattttctaaagagaagatgtgctttatacacatcagctccactaggactgctgcaaaaccaggcgcgaagcgtcgcctgagaacagcagcttctagggcccctggggtacgcacccacacgcagctgggttttgtgcgagaggcagtgagagccgggctgacctggcttcccgaggcattccctgcaggggaaccaggggggtggagcccaccctccccgtgctatctgaacaccggccatccccctccccaaacccacaaccccaggagtgagagccccggcgcagcctcaccgtggccaggtccttctgcgtaagccccttgctctgccgaccttgctggatcaccttgcccacctccagggtcaccctgtcatggtgcagctcctctgtctcccggtccagcttggccgtgttcttggtaatagaatgttgtttgttctggccagcagc

SEQ ID NO: 257 - DNA, 2541 bp, Artificial Sequence
  Description of Artificial Sequence: Synthetic polynucleotide
ctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctggtgagtccccaggacgcccctggccctaatttcctccagctgcgcacctccggccctcactgcacgcgccagccttctttgtgcggtcgggtaaacagagggcggagtccccttggcctcgcctcccgctaaccattgttgcctccatctcttcccgtagggcttctatttcgactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctggaaatagaggcgcacctcgtgcagtgcccacaacacgcggcagtccacaccgctgcgtggtcttagggacgtatagctgtaagagctaggacagggtgcggagagtgataaatacaagctgtcacatgtctttgtggcctgggcctctgacccccaacgactcttgggaaatgtaggtttagttct

SEQ ID NO: 258 - DNA, 2541 bp, Artificial Sequence
  Description of Artificial Sequence: Synthetic polynucleotide
tggggcggggggctgagactcctatgtgctccggattggtcaggcacggccttcggccccgcctcctgccaccgcagattggccgctagccctccccgagcgccctgcctccgagggccggcgcaccataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatctctctctggtgagtccccaggacgcccctggccctaatttcctccagctgcgcacctccggccctcactgcacgcgccagccttctttgtgcggtcgggtaaacagagggcggagtccccttggcctcgcctcccgctaaccattgttgcctccatctcttcccgtagggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctgga

SEQ ID NO: 259 - DNA, 2541 bp, Artificial Sequence
  Description of Artificial Sequence: Synthetic polynucleotide
ctttgcatagtttatcctattagtaatctattctgtctttggaatatgttttgtgatgatgaaataaatactataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagtttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcat

SEQ ID NO: 260 - DNA, 2541 bp, Artificial Sequence
  Description of Artificial Sequence: Synthetic polynucleotide
gctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacattgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattatacaatgttattattaactatagtcactatgctgtccagtagagcttcagatcttgttcatcttgtgttcctccctccccaccctcagtccctggaa

SEQ ID NO: 261 - DNA, 2541 bp, Artificial Sequence
  Description of Artificial Sequence: Synthetic polynucleotide
ataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattat

SEQ ID NO: 262 - DNA, 2541 bp, Artificial Sequence
  Description of Artificial Sequence: Synthetic polynucleotide
tagtgacggtatcaagagcagcatcccaggttgactttctttggggcaggaccttgcttgtgtcttaacccttggttcctacccaagtttgtctctctagtcctcaactctgaaagccacttgatatcttacacaattccttttttgcctgagaaaataaaagtcagttttgatcatttacaaccaaaaatcctaactaacacagacctgtttttgaaatcaggtagattggaagtcttggtttacttcttataagcccgtccgctgtctgtcttgtaacatcccaggagcagacttaacaaggccttcctggagccttgctctttctgtctgcttccctcatctgctctctctcctctctcttcacagggtccacttcctaacacatgctgccatttctggcttatggtttggcagcagaagaccaaagcagttgtcatgctgaaccgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatattgtggagaaagaatcggtgagtaatatttaatatttacaacttagtatactgtatgtgatcattagcatataaagattttcattttggggccaatattcattccttagttttggcctttaattgctaaaggctagcggtcaaagtgtttctgtccggaaaaactcatgtatccttttcctttcttaagtatttttataacaattgcagacctttcatctccaagatagaaatacaatggaataaatatggactagcagtgacatatagatctttggaatccctaggaatccttattgacctattgtcaataagtcctcttccagctttaagatcttgtactgttctacttcagatttcttactttattctacatttcataattgctggtttttaatgatgatgaaaatttcctaatccacttctaattagatgtggcaatgacatgcc

SEQ ID NO: 263 - DNA, 2541 bp, Artificial Sequence
  Description of Artificial Sequence: Synthetic polynucleotide
cagaatttgaatatgatgtggctgaccatagatacctccattgcattaattctgcttcataaagtgtttgatgcttgcttgtaggtgttgaatagagcctaattagcagtaagtaaacagatctagagcacagactttggcatctgaaggaccttggttcaatgctgggactgccacttactagctatgggatctttggtggatttttaacctttgaaagcctttcatccctcacagatataatggggaagaaaatcgtttccattagtattgtgaggattaaatgattaattgatgtaaacaatgtgctttccatagtacttggcatatcataagtgcttcatgttattttacgctggctgggaagataagttttgctgtggagaatttaagagggatattaaaatatatttttgttattttaaggaaattcgaaatgagtcccatgactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattatcctcatagagtggccaagtttccagaaaacagaaatcgaaacagatacagagatgtaagcccatgtaagtacttgtgggtttgtgtgcatgtgtattttttggtttgttttaggaggcaggatgtagtgaaaaggagggcttggggtcagtgttgataaatacagtaatttttttcctatttacgtaagacacgttctttaagaatttaaaggtgtagaatagtggaaggaaaaataattacccataattatttcatccttcaaacataggcaccattattttggtgtatttcccacaacctgtttttcttatgcacagttttcctttctttaaaataattgtaattatagatgtctatataatatccatatgtatttccttttcatatcattccatcccctttgtaagttttgcttaaaatagttattggtgtagtttggtttttt

SEQ ID NO: 264 - DNA, 2541 bp, Artificial Sequence
  Description of Artificial Sequence: Synthetic polynucleotide
accagttatcgttttgtaggtagaccaatcaattcttaggtaccaagaatctgaatgatccttttacttttaggaaggtaagtactttattcatttaactatgtttactcctggtcgatttttcaagtcacaatggctaatgtgctacaaacagaagtgcttcctttccagcactatagtaataaacaagattgcattttatactccttacaaaaaaagtagagaatagtttaggatttgtctcaactctattatgatgctaattcatttttcttatttcttctgtctttttataaatacctagaatattaatatgaagataaaaacagtaattttgaaatgacagttgtggtttatcattctctattttcagatgatcacagtcgtgttaaactgcaaaatgctgagaatgattatattaatgccagtttagttgacatagaagaggcatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcaaaggagttacatcttaacacaggcaagtaatacgataccacgcaaatgtctgaaaatgatgtgtttgtgcttgttctgctttaaatcataggtaaaagtatatcttgacttcttttggaaatgaaatggtatttcagtttttttctgacgatgtaatgaattatggacattataaggttttgaagctttgagtatttaagataaaaggcaagttatttttgatattacacgttctgtgaaggaaaattcttaggaaatggcttaggccagttctttggcagattgtgttccttacattatatctgacacagagtgctgcttatgcttcttagtgtcttcttttctcttcccataccctgtggcaaaaccagaggccctggacagctcttctgtagctccccctgcctcgcatatatcttcagagagtacaccaagccctggatggtgt

SEQ ID NO: 265 - DNA, 2541 bp, Artificial Sequence
  Description of Artificial Sequence: Synthetic polynucleotide
cctgctcaagggccgaggtgtccacggtagcttcctggctcggcccagtcgcaagaaccagggtgacttctcgctctccgtcaggtaggtgggccccccgcaaccccgggcattttggccactctcttgtgccatccaggccctgaaccactcattcctggttccccgtggcagtgctgactccccgtctgttcccttgcccccaacccccacactccccatccctgtctgtgcccacccatgcccatgtgtgcccccacccaggacctcagccgatccctgccctcctgcctctactcctgcaccgactggcctcaccgcctggtgccctgcagggtgggggatcaggtgacccatattcggatccagaactcaggggatttctatgacctgtatggaggggagaagtttgcgactctgacagagctggtggagtactacactcagcagtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagggtgtcctgcaggaccgcgacggcaccatcatccacctcaagtacccgctgaactgctccgatcccactagtgagaggtgagggctccgcacccccgccattcccaagcagggatgagccggctcccaccctgaacagccagggaggcagggagactggcagccggcgctgcctaccctccatcccctcccctccctgcaccagctggggctctcaatgtccctcctccctgctgtcctgggacctggtgtctcagagcctaacctaccaccctttccacctaaccccgaggaagccacagaaagctgcctcgccctactccgggagccctggccgctgcaacccaggtcccactggagacagggaggccactgctggtggccagcatgtcgtgcaggccagctctgttgttagaaagctcttcttcctctggaatcgagcctgcct

SEQ ID NO: 266 - DNA, 2541 bp, Artificial Sequence
  Description of Artificial Sequence: Synthetic polynucleotide
ctgggttcgaagcccggttagaactctggaggctaggatggcttgaacctgggaggtcgaggctgcagagagctgtaaccgcgccactgcactccagcctgggcaacagagctctggaagcttgccctagagtcagtcaagggccctaggccagtgagtaacagctcagcgtcagtttcctcatctataaaatgggggtaatatcatacctagctctcagcatgtttgtgagagacctaaatgaggtggtggatttggaagcatgtagcgcagtgcctggcacacagtaggtgcttgatttccggcccctctctgtgaatgtctctgctcagcgccttcccctgtggcctgggtcttaccttccctgacgctgccttctctaggtggtaccatggccacatgtctggcgggcaggcagagacgctgctgcaggccaagggcgagccctggtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacgtttcttgtgcgtgagagcctcagccagcctggagacttcgtgctttctgtgctcagtgaccagcccaaggctggcccaggctccccgctcagggtcacccacatcaaggtcatgtgcgaggtaaggcagccaggcggcgggggagcctctgctgaggctcctgtctgtgaccacagtgtgggtggcagggagggtctgcctgggcttgaattcaaggctggggacccagggagggagactcaagtcctgtgaatggcctaatttggctccccccagggtggacgctacacagtgggtggtttggagaccttcgacagcctcacggacctggtggagcatttcaagaagacggggattgaggaggcctcaggcgcctttgtctacctgcggcaggtcaggggtgggcccagctgcctccccacttcccctgagctgtcccccagatgt

SEQ ID NO: 267 - DNA, 2541 bp, Artificial Sequence
  Description of Artificial Sequence: Synthetic polynucleotide
tgtcacatatgtgcaatgccatgctcctgagcctttgattgcagacgtgtgggaagtgggccccgtccccacccccagtgccaccctgctctgcttctcttcccttgctgtgctctaaaacgagaagtacaagtgagttcccccaaggggtcggccgcgcctcttcctgtccccgccctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtaagggcctgccacccacggtagacaggaggcaagggtgcctggtgcccacgggacccctcctcactgccctgcctgggccgcccaggtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattggtttcaccgagacctcagtgggctggatgcagagaccctgctcaagggccgaggtgtccacggtagcttcctggctcggcccagtcgcaagaaccagggtgacttctcgctctccgtcaggtaggtgggccccccgcaaccccgggcattttggccactctcttgtgccatccaggccctgaaccactcattcctggttccccgtggcagtgctgactccccgtctgttcccttgcccccaacccccacactccccatccctgtctgtgcccacccatgcccatgtgtgcccccacccaggacctcagccgatccctgccctcctgcctctactcctgcaccgactggcctcaccgcctggtgccctgcagggtgggggatcaggtgacccatattcggatccagaactcaggggatttctatgacctgtatggaggggagaagtttg

SEQ ID NO: 268 - DNA, 2541 bp, Artificial Sequence
  Description of Artificial Sequence: Synthetic polynucleotide
tctttagctaatgttctgtagcttgttttagatctgtgtctacatattatatgtatctctgtatgcatcaatatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcagttctactctccttggaaggtgtcttaaatgggagtcttcccatttctttgtttcactctaga

SEQ ID NO: 269 - DNA, 2541 bp, Artificial Sequence
  Description of Artificial Sequence: Synthetic polynucleotide
agggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttccccctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgca

SEQ ID NO: 270 - DNA, 2541 bp, Artificial Sequence
  Description of Artificial Sequence: Synthetic polynucleotide
cctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaata

SEQ ID NO: 271 - DNA, 2541 bp, Artificial Sequence
  Description of Artificial Sequence: Synthetic polynucleotide
aaggaaaaaggcactgagtgctggggggtgctggggtgggctgcagtgatagacatcagggtagaggttaaggtcaggttcagcctcactggggtgaagtttgagcacggtgagcaggccatgcagcccgggggaggggaggatgggaggaggtggagctttccgggcagagggaacagccagtgcgaaggccccaggcaggtggcttaatgcagctgttgggggaggtgagtggtagggaggaggctggagggatgggggctgatctcacagggccagagcctggttgaccaaataaggccttggccttttctgcttggctgtcccaagaggatcccaaagagaaaaaaacgaaagtggtcttggtcacccagcctgccccacaccaggccccaccccaggtgctgagccctctgagcccctgcctgtctcccacaggctctgccctgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacg

SEQ ID NO: 272 - DNA, 2541 bp, Artificial Sequence
  Description of Artificial Sequence: Synthetic polynucleotide
aaggtcaggttcagcctcactggggtgaagtttgagcacggtgagcaggccatgcagcccgggggaggggaggatgggaggaggtggagctttccgggcagagggaacagccagtgcgaaggccccaggcaggtggcttaatgcagctgttgggggaggtgagtggtagggaggaggctggagggatgggggctgatctcacagggccagagcctggttgaccaaataaggccttggccttttctgcttggctgtcccaagaggatcccaaagagaaaaaaacgaaagtggtcttggtcacccagcctgccccacaccaggccccaccccaggtgctgagccctctgagcccctgcctgtctcccacaggctctgccctgcaccttagggctcgggatgctgctggccctgccaggggccttgggctcgggtggcagcgcggaggacagctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagt

SEQ ID NO: 273 - DNA, 2541 bp, Artificial Sequence
  Description of Artificial Sequence: Synthetic polynucleotide
cagtgcgaaggccccaggcaggtggcttaatgcagctgttgggggaggtgagtggtagggaggaggctggagggatgggggctgatctcacagggccagagcctggttgaccaaataaggccttggccttttctgcttggctgtcccaagaggatcccaaagagaaaaaaacgaaagtggtcttggtcacccagcctgccccacaccaggccccaccccaggtgctgagccctctgagcccctgcctgtctcccacaggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccc

SEQ ID NO: 274 - DNA, 2541 bp, Artificial Sequence
  Description of Artificial Sequence: Synthetic polynucleotide
atagagtagggcgggggatgccatggagaggctccatgggggagggccggggaagcgccgctccaggaggcacgtggtccggcgcggaaggggcccatgaggcgtggaggccgccgaggtcggggtaccgagggacgcagggaggccagcgcttcctcccgggcattcgagcggggcctcgtccttcgggagaacacattctccggagccctcttcgaacgtttattagtcggttcagggcaacttgaaggccaaatgtttggcccacaggccaataaatagtacgagagccaatcggcttaagggtttattccaggtgaggcgagtgtcttagaagatgggaaacacgtagatggcgtgtttttacggaagaactaaaatatttaatttttaggcaagtgtcgtggacttcgtactgctaggaagctccgtagtcaccgacgagaccagtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataagtggcatgataaacagtataagaaagctcatttgggcacagccctaaaggccaacccttttggaggtgcttctcatgcaaaaggaatcgtgctggaaaaagtgtaagtccattgctcccgtcaagttttagtttattataggaattcgagacatgaacttacgaattcttgttttgaaagtaattgcaggtttttgtgtagtagtattcatttgggcattgtggggtaaaattgcaaagcgtttgttctatttaaaagttggtaaaattagtttttgggaattaggtagttaaggttttaatttaacgttggcctggaaggaattggagaagatactagcaatgatgaagtaaaggacacaaacacctttactgtgggagttgttataagtaaatggcacgtgtcagctattgaactttatcgacttgataaaactaaggtgaagaga

SEQ ID NO: 275 - DNA, 2541 bp, Artificial Sequence
  Description of Artificial Sequence: Synthetic polynucleotide
caagcgggacttggggtcttggggacgggcgggcggatgcgaatagagtagggcgggggatgccatggagaggctccatgggggagggccggggaagcgccgctccaggaggcacgtggtccggcgcggaaggggcccatgaggcgtggaggccgccgaggtcggggtaccgagggacgcagggaggccagcgcttcctcccgggcattcgagcggggcctcgtccttcgggagaacacattctccggagccctcttcgaacgtttattagtcggttcagggcaacttgaaggccaaatgtttggcccacaggccaataaatagtacgagagccaatcggcttaagggtttattccaggtgaggcgagtgtcttagaagatgggaaacacgtagatggcgtgtttttacggaagaactaaaatatttaatttttaggcaagtgccgcggatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtgtaagtccattgctcccgtcaagttttagtttattataggaattcgagacatgaacttacgaattcttgttttgaaagtaattgcaggtttttgtgtagtagtattcatttgggcattgtggggtaaaattgcaaagcgtttgttctatttaaaagttggtaaaattagtttttgggaattaggtagttaaggttttaatttaacgttggcctggaaggaattggagaagatactagcaatgatgaagtaaaggacacaaacacctttactgtgggagttgttataagtaaatggcacgtgtca

SEQ ID NO: 276 - DNA, 2541 bp, Artificial Sequence
  Description of Artificial Sequence: Synthetic polynucleotide
ttgtatatcctttttaaagttattctttttagttaattgctctatgtgtattgagactaggaatcagaaagcttagattctagtcccaggtgtaagttgtgtaacccttggcaagtgtcaatctctaggcctcagctttctcatctataaaatgaggaagttgtcgtattctattttttttcttaagatgatacacttaaatgttcccttctgttgggttatataattgcatcaaaagtgtagtaatgttattaaaaaattgttagagatccaaactaaggtctctttcaactctcccattcttttttctgtgactttatggtaataatgaaactggtggttttcttttcttccccctcacagtatctcagagatgttaactgtcctttcaagattcaagatcgacaagaagctattgactggcttcttggtttagctgttagacttgaatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattatggagataatggtacgttttgtggggaatgtgtattttaaagagagaggaaagatgggaaagggagtgtgaaaatgtagggaactttgcagtttgttttgtctagtactattttacctttggtttattcttatcacaagttaaaagcacttttattgtctttcattggtgtttatatatttctgttagaatttggaaatggtgccctctggagaaggctaattgactgtcttctcacagagtaacactactttgataatatggtctgcaccttagcctttcaaattaaattgtttttagtgtcccagaattgatgggactttgaagtgttgttgcagtaggtaatttctcaaaagactgaaacatgtctaatgccaatatacattaatactctataggccagaatatattacttatgtttactgtcttagcacagatacttctatggt

SEQ ID NO: 277 - DNA, 2541 bp, Artificial Sequence
  Description of Artificial Sequence: Synthetic polynucleotide
gcacctgttatgtaggaggagtaataaaatgaatgaatgcactcaaaacactaaacagtaattctgtaatccaacgggaggtacagcgaataccaaaagcctacatatactattctctgcatgctatagcaagaaagaaaggaaagtggcttcccggtggttttctgcctattgtacaaccaggaagctgacaataaagtttatttgagcgtcgacgtgcgccgacgtggccccgcctccccagccggagccgcgattggtgggcatttgccggcggccaccgcttttaagccacgattggcgaaggccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataagttgacggctctcgactaccacaaccccgccggcttcaactgcaaaggtgaggcggcggcctcagcccggccgcgtgtccctgacctgggcggaggtcccagcctcagtgcccgcaccccacctccccgtcgggaccctcggcggcctggtttccgccggcagcctccgggcccctctcctctgggtcgccacgtacctcggctcttcgccgccccttcccgcctttaaagccctctcacctactcctgtctcggcatgttactttctgcacttgcttaactccaagcatcacgtaactaccttctctgtacataaaagggagagcattcgtctttctcactcactattcaactccatggttccctgggtaattaggcgataccttgagcacctgctaattatgggccagcgcggtgctggattctgaggaaggtgctgagtaacttg

SEQ ID NO: 278 - DNA, 2541 bp, Artificial Sequence
  Description of Artificial Sequence: Synthetic polynucleotide
cactaaacagtaattctgtaatccaacgggaggtacagcgaataccaaaagcctacatatactattctctgcatgctatagcaagaaagaaaggaaagtggcttcccggtggttttctgcctattgtacaaccaggaagctgacaataaagtttatttgagcgtcgacgtgcgccgacgtggccccgcctccccagccggagccgcgattggtgggcatttgccggcggccaccgcttttaagccacgattggcgaaggccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggtgaggcggcggcctcagcccggccgcgtgtccctgacctgggcggaggtcccagcctcagtgcccgcaccccacctccccgtcgggaccctcggcggcctggtttccgccggcagcctccgggcccctctcctctgggtcgccacgtacctcggctcttcgccgccccttcccgcctttaaagccctctcacctactcctgtctcggcatgttactttctgcacttgcttaactccaagcatcacgtaactaccttctctgtacataaaagggagagcattcgtctttctcactcactattcaactccatggttccctgggtaattaggcgataccttgagcacctgctaattatgggccagcgcggtgctggattctgaggaaggtgctgagtaacttgaagactagttcactgcctgccaggagctaaagggacgaggggtggaag

SEQ ID NO: 279 - DNA, 2541 bp, Artificial Sequence
  Description of Artificial Sequence: Synthetic polynucleotide
ccgggttaggcataggccctcccggatcttccgcggtgtaaggagaaggccagcgcccctgtgataggcccagagcccccactccacaagccagcccatcccccacggagacccaaaccgtccacacacaccttgccagctgtttgggccccacgccgccccaaaacacgcctccagctggccccttgggacctcccttctctagtccgtattttgacctggcccgtggcagattcgccactcccccctaccccaagcagcctgggcctcgatgggccgttgtcggggcccggagattgaagtggtgttggatcctgctgctggccgcgctggggtagaagggtcgccggtgtgtgggcagagcggcccccgcgtctcacctttaattttctttccttaggcggtaaccagcgtgagctcgcccgccagaagaatatgaaaaagcagagctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctcctcactggtgttgctgggtgtggtcctcaatacagaatagag

SEQ ID NO: 280 - DNA, 2541 bp, Artificial Sequence
  Description of Artificial Sequence: Synthetic polynucleotide
aatcgagccctttgcccacggctacttcacgggaccaccctcccgggttaggcataggccctcccggatcttccgcggtgtaaggagaaggccagcgcccctgtgataggcccagagcccccactccacaagccagcccatcccccacggagacccaaaccgtccacacacaccttgccagctgtttgggccccacgccgccccaaaacacgcctccagctggccccttgggacctcccttctctagtccgtattttgacctggcccgtggcagattcgccactcccccctaccccaagcagcctgggcctcgatgggccgttgtcggggcccggagattgaagtggtgttggatcctgctgctggccgcgctggggtagaagggtcgccggtgtgtgggcagagcggcccccgcgtctcacctttaattttctttccttaggcggtaactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagcgcgagcttgcccgccagaagaatatgaaaaagcagagcgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctc

SEQ ID NO: 281 - DNA, 2541 bp, Artificial Sequence
  Description of Artificial Sequence: Synthetic polynucleotide
ttcaaaaggaatctttttgtttcaactattaggatctttttaaatcaaatatgtattttaatggtgtacaccagacctgaagaaaaagatcacagaaggaatttcccctttgtaagatagaggtagttaaaaataagccttatgacctaataggttaattgtaatgctctggtagccaacttgaaaaaggagaaatgatggttgcatctcacattttaaaatgttaagaatttgttttgtaatgaggataccttaacccctgaaggccaaaatgactatttgtgtgagtttgagaaaggcacatagtaacttggggaacagtcaatagaatgacaaaatcttgactattttaactttctgaaccctgtcatttcttgtgttctcaaatttgatttttaaataggctgcatggtgtatgaaaagctgggggaacaagtctttggcaccacatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgggaagttcgtaatctttggagccacctctctacagaacactggaggtaaaaagaacatgcttttctttacataacttgaaactaattctggtggatgagcggccacatgaattttaacataattcaagcagttatcatcctcattgctaaaatggcacagggaaagtaaagcagagacagcagtcacttatttaaagccacaaatcctgctagagtagctgaagttgcctttgtgtcttactgacagttggtctaagaacgggctgataactttttatgtagcttgcaacataagccttcgtatcttctttctaaaaatgttctcattttccttcagcaatgctgagctacctcttcatcgtaaaaaatgaactaccctctgccataaagtttctaatgggaaaggaagagacattttcgtaagttatagaccatttttttatgatata

SEQ ID NO: 282 - DNA, 2541 bp, Artificial Sequence
  Description of Artificial Sequence: Synthetic polynucleotide
taaagatgtcaagcttcaaatcattatcataaggttaaatatattacgcatgtctttacagcaagtttatttctgatcgtgaaagtagaagaagtctcacaaacagccatttggaaaaaaagaagtgtgatgagtatgtaagtatcattataatgaagtatgcttatttttttaatcatataaattgggacaaatctttttaattcaagtagcatagtaccaaaagcataactacctgtattcaccaggatattcctcataccttatgtattttctcttgaaatccattcaaggaaataactagataactaagaatggattttcttgaattttacttccatattggttcctgagagtgcattaaaggctttggcttgatgaactttcttggggattattttgcttagtgtcaatgtttgtttctttgttcagattccaggtacaacctcctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttaggcatgtcagtttttaacctaagcaacgccattatgggcagtgggattttgggactcgcctttgccctggcaaacactggaatcctactttttctgtgagtattgacgtgccggtactttccattttaaaactgaactttttgtatgtttctgttattacatagaagaaatgtgaaatatttataaatagtttttttattaacttggctaagttacaagtacatactttgatatttattgcttgagtgattttccaaactgtacctaatgcttacaacaaagaggaaggagaaaatctttttattaatcaaaaatactgaaataagcatttgtgaaaaggattaaaacatttgaaaataactttttttggtatttttggagtctacctgtgactttaaatctcagttaaaatattaagaggtgtttaaccccagccagtcaccactt

SEQ ID NO: 283 - DNA, 2541 bp, Artificial Sequence
  Description of Artificial Sequence: Synthetic polynucleotide
atcattcttcacactagttccttttctgactcttcagtcacctccagaattaatatccttagaagcatctctaaaatgagtttgatttactaaacatagaagttgacaaagtttttcaagtataactgcataaactctcttttttaaaaaatcagtttttcccaagttgttagcctttcattggcatttgagtcatttatgtgacatatttataagaaacatctgctagtgctgctgcatacttttatcagatccattaaatagtacatttttgttcttgattctcactaaaactaactaaatggctgtcattcttttctttatgcttttattgtactaatttagcccatttgactgcacttttttttttttttttttaaagttccctcctttcttttccccttgcttcccaacaggtctcttgatggtcgtctccaggtatcccatcgatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccaggtaggaatattgcaagtttttttcttggttttgaattaaatgcctgaacttcagtatatttaagtactcttgtgacccaggaaaattttagtgtaaattctaataaattaccttaaattgtgcatattatttggtggtaattaaaatttttttatttttaaaaatttttaatgagaaaacatatctgtttcttggaatagcatatgatttggcatgaaagtgcatatccaggaaatcctgtagattggcagtctgctcagcgctatgctgatgtgcttctacatgtccct

SEQ ID NO: 284 - DNA, 2541 bp, Artificial Sequence
  Description of Artificial Sequence: Synthetic polynucleotide
ttctatattaaaaatcagttgacatctgtttttagataattttttaaaaaactggattataaaatgaagcacttagtaaagctgatggcagaggttttagatcttttgaatacaggaaagtggtaagggcattataggtatgattcattgagctagagggcgttggtgttcacattttaaaaacataatcatgacttatctggagtcacatgttccattttattggcttccttcatatagaaaatatagtaaccagcactacatgcctgtgaaaaagtgaagcaattgtatattttctgggtgaaggaagtattctgtacattctccatgttttacatcatggtattttgaataaccatgcttccatgttcacatcaattttttgtttttcaatttatgcacagcacttgctctgaaatttggggactgagtacaccaaatacgatagattgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcagtgggatacaacaggcctttacagcttctctgaacaaaccaggtgaatattctgccctctgtcgaatcttagagatcttgtgggaggggggtatattttgaaagacctatatggggttgcttagtataattttgcctaggatgtttccttaatgtaaaataaggcatagcatttaaaatatctgcttgccagtataaaaaatatattaaatgtttcagctgatgttttaatcaatgcaattctagtttgaatcttctttaaattactgtatcccctaaagaataataattttgataactatatatttattttagcttgagatcagattataatctgttgttggcctaatttttaagtagatacatgatgagttttgctaaatttcttgttatcagaatctcatctttatactaataaatacatacttaatgaaccccttatatcacaa

SEQ ID NO: 285 - DNA, 2541 bp, Artificial Sequence
  Description of Artificial Sequence: Synthetic polynucleotide
tcaatgtatttttgtatagtcttttgagattagagtgaagttctaaaaagtaagagaaccttttgtgaaaatattttaattgacactactaagagtttaaaatagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttca

SEQ ID NO: 286 - DNA, 2541 bp, Artificial Sequence
  Description of Artificial Sequence: Synthetic polynucleotide
gggctcccgcagcacagcctttctccggccctagcccaaatcgcccagaccaggcgcggatcccagcctggccagcaggcggcgggcgcggggcggcgagccggggccggacggctggagccagaaccggctgctctccacgcccccctctcggtgctgcccggaggccggactccgcctccaccgagcccccacccgccgggaagagctccgcggagtacagagcccattttctagctgtgtccactgaggctgaacggatccgcgcggacttggtgctccgtgctcgccccctagggccgggtccgccgggagcgccgccctccggagttgtccggccggcgcacacctgcccggccccgcagcgccccagctcacctctttgtctctcccgcagcgcacccccggacgctatggcccacccctccggctggccccttctgtaggatgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctg

SEQ ID NO: 287 - DNA, 2541 bp, Artificial Sequence
  Description of Artificial Sequence: Synthetic polynucleotide
ggatcccagcctggccagcaggcggcgggcgcggggcggcgagccggggccggacggctggagccagaaccggctgctctccacgcccccctctcggtgctgcccggaggccggactccgcctccaccgagcccccacccgccgggaagagctccgcggagtacagagcccattttctagctgtgtccactgaggctgaacggatccgcgcggacttggtgctccgtgctcgccccctagggccgggtccgccgggagcgccgccctccggagttgtccggccggcgcacacctgcccggccccgcagcgccccagctcacctctttgtctctcccgcagcgcacccccggacgctatggcccacccctccggctggccccttctgtaggatggtagcacacaaccaggtggcagccgacaatgcagtctccacagcagcagagccccgatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgc

SEQ ID NO: 288 - DNA, 2541 bp, Artificial Sequence
  Description of Artificial Sequence: Synthetic polynucleotide
cggactccgcctccaccgagcccccacccgccgggaagagctccgcggagtacagagcccattttctagctgtgtccactgaggctgaacggatccgcgcggacttggtgctccgtgctcgccccctagggccgggtccgccgggagcgccgccctccggagttgtccggccggcgcacacctgcccggccccgcagcgccccagctcacctctttgtctctcccgcagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttc

SEQ ID NO: 289 - DNA, 2541 bp, Artificial Sequence
  Description of Artificial Sequence: Synthetic polynucleotide
ggcagacaaacagttaaaacagaggagtggggtaagtgatgacctaacccagccccgctgctctagttttgttaaacacctcatctgctatcacggtctggcgaaaccctggagaaactattatttccacgacggaaacatgtaatatcgaagcacgttaaattccactcaaagtggcggcgtctgggatccctgacaaagagccctgggctgcttggggcccattgttaccagaagcaacctaggcggctcagtgctggggactgagccagctacaatccctactattttccgggcccgaagccccgaatgtgctcagtacagggtggggaaaggtagaggaaggcggcggtccgcggcagacagactccggtggctcccagacaccgggaacccagggagcatcgcccggctcccctcccgctgcttacacttcttcaaggtgatatatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgacgctgcccgacgtccggcacttctggaaaagtctggtcagctccgtcaggaactggaaaacaacaggcccagccccgttagccagccccaaatcctcgtcctgccgcgtcaaggccctggtcctcctgcaggaggcacaggtctcgagtaacgcctgagccgcccccttccctcggccggccaggcctagccatacctgctcgctctccaacaacaccatcgcggcgacgctggctcgactccctccgcttaagcccctagcagtgagagccggaagttcggcctaggctgggcgggacttccgctactagacttccattgtcttccaccaatctcttctcttccaccaatcccggcctgcgccctcccccctccccgcccgcctagcgcccgcgccctgggacgtccgggggcctgtgacccggaggcgctggggctgtcctgggtc

SEQ ID NO: 290 - DNA, 2541 bp, Artificial Sequence
  Description of Artificial Sequence: Synthetic polynucleotide
gtctgtctgccgcggaccgccgccttcctctacctttccccaccctgtactgagcacattcggggcttcgggcccggaaaatagtagggattgtagctggctcagtccccagcactgagccgcctaggttgcttctggtaacaatgggccccaagcagcccagggctctttgtcagggatcccagacgccgccactttgagtggaatttaacgtgcttcgatattacatgtttccgtcgtggaaataatagtttctccagggtttcgccagaccgtgatagcagatgaggtgtttaacaaaactagagcagcggggctgggttaggtcatcacttaccccactcctctgttttaactgtttgtctgccgctcagccacgtacgcggccgtgttcaccaggatgcattttttccttcagatgacggtcgaaccaaacccattccaaagaagtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggtactgtggagggctttgagcccgcagacaacaagtgtctgttaagagctaccgatgggaagaagaagatcagcactgtggtgagcttaatttctaaggctgtcttttgaaatgtaaagacttgaacttaacagaggatggggcgtttctgaaccaggcttttatttgtttttcccttttgccctgtgtggctatttttgagaccaggaccttcctatactttagtagtggaaacctcaagaataaaataagaaggtagaggtcagacagtcgttagttctgctaaagctcttgtggaaatgaaagtagcatattggtccttattcgtagtactgtaaggagcagctggcataaatatttgattccttagccccttactgtgctgggccttcaataagcagtttcttggtaccaggtgatgctattatttccttatctttgtggttcac

SEQ ID NO: 291 - DNA, 2541 bp, Artificial Sequence
  Description of Artificial Sequence: Synthetic polynucleotide
cccacgtcagtgagtgctcacaagtctgtgaggtaggcggcgccacagagagaaactgaggcgcgggagcccaagccacttgtccagcgcctcagccgagcgcgaaccgcgctcggggatggcatccacacggcccggccccaggctctccctgtcagcgcccgaaggcccttcgcacctccagggggcgccggcctgcgcgcacgcgcaatggtcgcagccgcgttctctttaagaggactccttttgcctccgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccggtgaggcccccgcgcccctgccctctcctcctcggtgcctgaggcccccgccttccctgctgtcccctcccccagggctcccctccccccggcctcccctccccccgcctccgcgcagacccctcacggcgccccctcacgggtggaggatgaggcagcctctcctcgcaggcccgggccgtccttcgcgccgtcgtcacttcctttatttttattattccaatattttacttagaaacccaaaagctgagcctttggagggcccaagcccgcctgcaccggcctcggggggtccaaatgagccttgtccgcc

SEQ ID NO: 292 - DNA, 2541 bp, Artificial Sequence
  Description of Artificial Sequence: Synthetic polynucleotide
tgtggtgtgcttttcgagaaaatgctcacgaagattagaaaaacactgatggtttattggcaaaatcaataatctgtcagcagttgattcttttttttctctgaattagccctcttatgagtaatctgtttgctcattcattataatttcatacctctaaaactgcgtgtgacagctgtaaaggttaattccagtatcatgaaacgtctccaaaccaaagcagaagtgcttcaggatcctgatttgtgtgtttttttcttcactctaggtttcccttttatgcttactactcatgcccctcacttggaaagtcacttggcctcctgaacagcactaactccaaacgttttttttgttgttgttgttttttttagagatgcagaggatgctatttatggaagaaatggttatgattatggccagtgtcggcttcgtgtggagttccccaggtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacttatggaggtcggggtgggtggccccgtggtgggaggaatgggcctcctacaagaagatctgatttccgagttcttgtttcaggtatgttcctttcaaacagaatgagatgatacatgtaaaatacttaacacagagtctgtcttccaagaaatgatagctgttattcttcagtgcatgggacacgggggctttcttttcaatagcctgtgtgaagccttgccctggattgccaatgaggaaagtatcctgcaaatgaaattgcgctgggagtgcagccttggaagaacataaccatatttcttgtaaaggagttttctagtggtgagaaggaaagatgatgggaaaacttgagctacaattctaaagatgcttcttttggaatatacttggcatcagacatggtagaaaggcattcaaggagccagatttgaacaacttacccagcc

SEQ ID NO: 293 - DNA, 2541 bp, Artificial Sequence
  Description of Artificial Sequence: Synthetic polynucleotide
gatggcatccacacggcccggccccaggctctccctgtcagcgcccgaaggcccttcgcacctccagggggcgccggcctgcgcgcacgcgcaatggtcgcagccgcgttctctttaagaggactccttttgcctccgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgtgcgcttcgaggacccccggtgaggcccccgcgcccctgccctctcctcctcggtgcctgaggcccccgccttccctgctgtcccctcccccagggctcccctccccccggcctcccctccccccgcctccgcgcagacccctcacggcgccccctcacgggtggaggatgaggcagcctctcctcgcaggcccgggccgtccttcgcgccgtcgtcacttcctttatttttattattccaatattttacttagaaacccaaaagctgagcctttggagggcccaagcccgcctgcaccggcctcggggggtccaaatgagccttgtccgcctcctgcctggggcagcaccgtagggggaagcggccgcggggcagcgcgggggtcgccgttcgcccttcccgctcgcctctcccccggcccgtgctcgccgtggctggagagcaagct

SEQ ID NO: 294 - DNA, 2541 bp, Artificial Sequence
  Description of Artificial Sequence: Synthetic polynucleotide
gtaactgactagccttagtagactgtggtttccaggtttattcagaagtagcaagatccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttaaagaggaaaaagcaagttgctccagaaaaacctgtaaagaaacaaaagacaggtgagacttcgagagccctgtcatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattcttctaaacagagcagcagcagcagagatgataacatgtttcaggtaaagttggctattttttttttttttttttttgacatggagtcatgctctgtcacccaggctggagtgcagtggcgccatctcggctcactgcaacctcagcctcctgagttcaagcagttctctgcctcagcctcccgagtagctaggattacaggcatccgccaccagacctggctaatttttgtatttttagtagagatggggtttcaccatcttggccaggctggtcttgaactcctgaccttgtgatccaactgcctcagcctccaaaagtgctgggtttacaggtgtgagccaccatgccttgccaaagttggctgtttctttagattcagaggaattattatctggcttgatctgaagaatgttaaaagtactatgatctgataattgcctaatatg

SEQ ID NO: 295 - DNA, 2541 bp, Artificial Sequence
  Description of Artificial Sequence: Synthetic polynucleotide
ataaataaacatatcctggaaatggaataagttggttatattctttttaattagtatatctgcttcgtaaaataagtaactgactagccttagtagactgtggtttccaggtttattcagaagtagcaagatccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataagaggaaaaagcaagttgctccagaaaaacctgtaaagaaacaaaagacaggtgagacttcgagagccctgtcatcttctaaacagagcagcagcagcagagatgataacatgtttcaggtaaagttggctattttttttttttttttttttgacatggagtcatgctctgtcacccaggctggagtgcagtggcgccatctcggctcactgcaacctcagcctcctgagttcaagcagttctctgcctcagcctcccgagtagctaggattacaggcatccgccaccagacctggctaatttttgtatttttagtagagatggggtttcaccatcttggccaggctggtcttgaactcctgaccttgtgatccaactgcctcagcctccaaaagtgctgggtttacaggtgtgagccaccatgccttgccaaagttggctgtttcttt

SEQ ID NO: 296 - DNA, 2541 bp, Artificial Sequence
  Description of Artificial Sequence: Synthetic polynucleotide
aattagtatatctgcttcgtaaaataagtaactgactagccttagtagactgtggtttccaggtttattcagaagtagcaagatccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttaaagaggaaaaagcaagttgctccagaaaaacctgtaaagaaacaaaagtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacaggtgagacttcgagagccctgtcatcttctaaacagagcagcagcagcagagatgataacatgtttcaggtaaagttggctattttttttttttttttttttgacatggagtcatgctctgtcacccaggctggagtgcagtggcgccatctcggctcactgcaacctcagcctcctgagttcaagcagttctctgcctcagcctcccgagtagctaggattacaggcatccgccaccagacctggctaatttttgtatttttagtagagatggggtttcaccatcttggccaggctggtcttgaactcctgaccttgtgatccaactgcctcagcctccaaaagtgctgggtttacaggtgtgagccaccatgccttgccaaagttggctgtttctttagattcagaggaattattatctggcttgatctgaagaatgttaaaagt

SEQ ID NO: 297 - DNA, 2541 bp, Artificial Sequence
  Description of Artificial Sequence: Synthetic polynucleotide
cacattttaatttttgtttccatgctctttagaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatc

SEQ ID NO: 298 - DNA, 2541 bp, Artificial Sequence
  Description of Artificial Sequence: Synthetic polynucleotide
aatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagctt

SEQ ID NO: 299 - DNA, 2541 bp, Artificial Sequence
  Description of Artificial Sequence: Synthetic polynucleotide
ggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacat

SEQ ID NO: 300 - DNA, 2541 bp, Artificial Sequence
  Description of Artificial Sequence: Synthetic polynucleotide
aaagggaggttgagatgggctgaggtcttctaggaggcggggagggagtgcagccttgacaagcctccctgtgggcgaggtgtaaagaggggcagaagtcagctctggaagcatagggcagtgggtggggaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcc

SEQ ID NO: 301 - DNA, 2541 bp, Artificial Sequence
  Description of Artificial Sequence: Synthetic polynucleotide
gaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcctcacccagaccaattcaatcagaatccctaatagcagagctaaacaagggtaaggtctaaaagcatttccaggtgattctaatgggcagccaatactgagaaccactgttcttatgtaagaagcacatc

SEQ ID NO: 302 - DNA, 2541 bp, Artificial Sequence
  Description of Artificial Sequence: Synthetic polynucleotide
cctccctgtgggcgaggtgtaaagaggggcagaagtcagctctggaagcatagggcagtgggtggggaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacaacggggaacatttctgcagagaaaggtggctctatcatcttacaatgtcacctctcctccacctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcctcacccagaccaattcaatcagaatccctaatagcagagctaaacaagggtaaggtctaaaag

SEQ ID NO: 303 - DNA, 2541 bp, Artificial Sequence
  Description of Artificial Sequence: Synthetic polynucleotide
taatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagattgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccaga

SEQ ID NO: 304 - DNA, 2541 bp, Artificial Sequence
  Description of Artificial Sequence: Synthetic polynucleotide
gattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaag

SEQ ID NO: 305 - DNA, 2541 bp, Artificial Sequence
  Description of Artificial Sequence: Synthetic polynucleotide
ttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcacc

SEQ ID NO: 306 - DNA, 2541 bp, Artificial Sequence
  Description of Artificial Sequence: Synthetic polynucleotide
attattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagcccctt

SEQ ID NO: 307 - DNA, 2541 bp, Artificial Sequence
  Description of Artificial Sequence: Synthetic polynucleotide
ttcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttattttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactc

SEQ ID NO: 308 - DNA, 2541 bp, Artificial Sequence
  Description of Artificial Sequence: Synthetic polynucleotide
cagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccatgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatg

SEQ ID NO: 309 - DNA, 2541 bp, Artificial Sequence
  Description of Artificial Sequence: Synthetic polynucleotide
tgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgaccctgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatgagagggagccccgcctgctgccctgtttgcactcggcctgtagtgcctgcttagggcccgcggcccccgccgccgccaacagctcgggggacggcggggcggcgggcgacggcaccggtaagtacgaagtgatcggtgccacccctccccctactctctgcctttgattccgactgggtgcagagatgaggatgccacctgggcgagaggatgggggcccggacagggcacgggaaatactttctgggtcctgcatacgaacgtgggtttgtgctggccgctgagatgggacatctgactaaagttggagaaaagaaggctcggggaggggaggggctggttcgctgcgggataatggtcgggggcccacccagcaggggaatggtgggggccataacctgggtgggaacttgtaacagtctcccacatccctgcttctcgaagtggtg

SEQ ID NO: 310 - DNA, 2541 bp, Artificial Sequence
  Description of Artificial Sequence: Synthetic polynucleotide
tcgaagtggtggactgtcccgtgtgcaagcaacagtgcttctccaaagacatcgtggagaattatttcatgcgtgatagtggcagcaaggctgccaccgacgcccaggatgcgaaccaggtgcgtcctatctcagcaaccacaaggaggtttctggggagggggcatctgcgcaggaggagcttggcaccagctccaggctgttactccactttcccaaggctctgggtgggctgcctaggttgggtcaagggaccaatcttaaatctccggttgtattttctgggatgtaaacgtggatctatcaagttgtcttgccttctctgaccctgcctttgtctggcagtgctgcactagctgtgaggataatgccccagccaccagctactgtgtggagtgctcggagcctctgtgtgagacctgtgtagaggcgcaccagcgggtgaagtactgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttataccaaggaccatactgtgcgctctactggtacatgaggctgaggggggctgttggagttgttctcccatgtgtgccctcagttgcttttatgatgttggttgcatctggtggatgggtcctagagttctctagggggtgccgcccgaagggcccgagggcagaactccagaagcagaaaaactggggttgtggtgtgtagtctctagggcctaggtgggagagggtgggaaggggaaataagggagaccttaatgtgctgcagggaggtacaaagggtttgagaaggcttatcagggagttgtcagacctggtggtgaagggctcagcatatgcaaacagggaaaggcatggtgtgaagggctttctgggtttgtggttccctggcacacatctggtataagatgctgctagggaaagtagactgtgggtccatggattataagtgatga

SEQ ID NO: 311 - DNA, 2541 bp, Artificial Sequence
  Description of Artificial Sequence: Synthetic polynucleotide
ggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgcttgacgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagctagcgaattgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaatgattgtttattgcagcttataatggttacaaataaagcaatagcatcacaaatttcacaaataaagcatttttttcactgcattctagttgtggtttgtccaaactcatcaatgtatcttatggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccggtaagtacgaagtgatcggtgccacccctccccctactctctgcctttgattccgactgggtgcagagatgaggatgccacctgggcgagaggatgggggcccggacagggcacgggaaatactttctgggtcctgcatacgaacgtgggtttgtgctggccgctgagatgggacatctgactaaagttgg

SEQ ID NO: 312 - DNA, 23 bp, Artificial Sequence
  Description of Artificial Sequence: Synthetic oligonucleotide
  modified_base (21)..(21): a, c, t, or g
gagccatgcttggcttacgangg

SEQ ID NO: 313 - DNA, 23 bp, Homo sapiens
gagccatgcttggcttacgaggg

SEQ ID NO: 314 - DNA, 23 bp, Homo sapiens
aatccatgtttcgctttccatag

SEQ ID NO: 315 - DNA, 23 bp, Homo sapiens
cagccatgattgggctcctatgc

SEQ ID NO: 316 - DNA, 23 bp, Homo sapiens
gatgaatgattggcttcagatgg

SEQ ID NO: 317 - DNA, 23 bp, Homo sapiens
gtgccttgctagttttaagatgg

SEQ ID NO: 318 - DNA, 23 bp, Homo sapiens
gaaccctgctgggctcaggttag

SEQ ID NO: 319 - DNA, 23 bp, Homo sapiens
gtgcctcccttggctgaagaggc

SEQ ID NO: 320 - DNA, 23 bp, Homo sapiens
gagccatgattgtgccaccactg

SEQ ID NO: 321 - DNA, 23 bp, Homo sapiens
cctccatgcttggcttggcatga

SEQ ID NO: 322 - DNA, 23 bp, Homo sapiens
gagtaatacttggctcagcagtg

SEQ ID NO: 323 - DNA, 23 bp, Homo sapiens
gagccagggagggcttcccagag

SEQ ID NO: 324 - DNA, 23 bp, Homo sapiens
gtgacattctttacttaccacag

SEQ ID NO: 325 - DNA, 23 bp, Homo sapiens
gagccaggcttgggctcaggtgc

SEQ ID NO: 326 - DNA, 23 bp, Homo sapiens
gagccagtgttgggagacgattg

SEQ ID NO: 327 - DNA, 23 bp, Homo sapiens
aagccagatttggatttcgaagt

SEQ ID NO: 328 - DNA, 23 bp, Homo sapiens
cagccatgctctgcatatgcagt

SEQ ID NO: 329 - DNA, 23 bp, Homo sapiens
gaggcaggtttgccttaagcagt

SEQ ID NO: 330 - DNA, 23 bp, Homo sapiens
gacacatgccttgctaactaaag

SEQ ID NO: 331 - DNA, 23 bp, Homo sapiens
cagcagtgatgggctcacgacgg

The invention claimed is:

1. An engineered cell, comprising at least one sequence encoding a transgene, wherein the at least one sequence is inserted within a safe harbor locus and wherein the safe harbor locus is at a chr11:128340000-128350000 target loci.

2. The engineered cell of claim 1, wherein the safe harbor locus is a GS94 integration site comprising a start coordinate of chr11:128342576.

3. The engineered cell of claim 1, wherein expression of the at least one sequence encoding the transgene is operatively linked to an endogenous promoter.

4. The engineered cell of claim 1, wherein expression of the at least one sequence encoding the transgene is operatively linked to an exogenous promoter.

5. The engineered cell of claim 4, wherein the exogenous promoter is an EF1α promoter.

6. The engineered cell of claim 1, wherein the engineered cell is a natural killer (NK) cell, an induced pluripotent stem cell (iPSC), a human pluripotent stem cell (HSPC), a T cell or a T cell progenitor.

7. The engineered cell of claim 1, wherein the transgene encodes at least one of a recombinant protein, a therapeutic agent, or a chimeric antigen receptor (CAR).

8. A composition comprising the engineered cell of claim 1 and a pharmaceutical excipient.

9. The engineered cell of claim 1, wherein the engineered cell is a T cell.

10. The engineered cell of claim 1, wherein the engineered cell is a CD8+T cell.

11. The engineered cell of claim 1, wherein the engineered cell is a human cell.

12. The engineered cell of claim 1, wherein the engineered cell is a human T cell.

13. The engineered cell of claim 1, wherein the engineered cell is a human CD8+T cell.

14. A composition comprising the engineered cell of claim 12 and a pharmaceutical excipient.

15. A composition comprising the engineered cell of claim 13 and a pharmaceutical excipient.

16. An engineered cell, comprising at least one sequence encoding a transgene, wherein the at least one sequence is inserted within a safe harbor locus and wherein the safe harbor locus is at a chr15:92830000-92840000 target loci.

17. The engineered cell of claim 16, wherein the safe harbor locus is a GS102 integration site comprising a start coordinate of chr15:92831131.

18. The engineered cell of claim 16, wherein expression of the at least one sequence encoding the transgene is operatively linked to an endogenous promoter.

19. The engineered cell of claim 16, wherein expression of the at least one sequence encoding the transgene is operatively linked to an exogenous promoter.

20. The engineered cell of claim 18, wherein the exogenous promoter is an EF1α promoter.

21. The engineered cell of claim 16, wherein the engineered cell is a natural killer (NK) cell, an induced pluripotent stem cell (iPSC), a human pluripotent stem cell (HSPC), a T cell or a T cell progenitor.

22. The engineered cell of claim 16, wherein the transgene encodes at least one of a recombinant protein, a therapeutic agent, or a chimeric antigen receptor (CAR).

23. A composition comprising the engineered cell of claim 16 and a pharmaceutical excipient.

24. The engineered cell of claim 16, wherein the engineered cell is a T cell.

25. The engineered cell of claim 16, wherein the engineered cell is a CD8+T cell.

26. The engineered cell of claim 16, wherein the engineered cell is a human cell.

27. The engineered cell of claim 16, wherein the engineered cell is a human T cell.

28. The engineered cell of claim 16, wherein the engineered cell is a human CD8+T cell.

29. A composition comprising the engineered cell of claim 27 and a pharmaceutical excipient.

30. A composition comprising the engineered cell of claim 28 and a pharmaceutical excipient.

\* \* \* \* \*